US008999633B2

(12) United States Patent
Chin et al.

(10) Patent No.: US 8,999,633 B2
(45) Date of Patent: Apr. 7, 2015

(54) COMPOSITIONS, KITS, AND METHODS FOR IDENTIFICATION, ASSESSMENT, PREVENTION AND TREATMENT OF PANCREATIC ADENOCARCINOMA IN HUMANS

(75) Inventors: Lynda Chin, Brookline, MA (US); Cameron W. Brennan, New York, NY (US); Ronald A. DePinho, Brookline, MA (US); Andrew J. Aguirre, Boston, MA (US)

(73) Assignee: Dana-Farber Cancer Institute, Inc., Boston, MA (US)

( * ) Notice: Subject to any disclaimer, the term of this patent is extended or adjusted under 35 U.S.C. 154(b) by 2121 days.

(21) Appl. No.: 11/597,825

(22) PCT Filed: May 27, 2005

(86) PCT No.: PCT/US2005/018850
§ 371 (c)(1),
(2), (4) Date: Jun. 16, 2009

(87) PCT Pub. No.: WO2005/118869
PCT Pub. Date: Dec. 15, 2005

(65) Prior Publication Data
US 2009/0297536 A1  Dec. 3, 2009

Related U.S. Application Data

(60) Provisional application No. 60/575,795, filed on May 28, 2004, provisional application No. 60/580,337, filed on Jun. 15, 2004.

(51) Int. Cl.
*C12Q 1/68* (2006.01)

(52) U.S. Cl.
CPC ........ *C12Q 1/6886* (2013.01); *C12Q 2600/136* (2013.01); *C12Q 2600/154* (2013.01)

(58) Field of Classification Search
None
See application file for complete search history.

(56) References Cited

U.S. PATENT DOCUMENTS

| | | | |
|---|---|---|---|
| 5,569,753 | A | 10/1996 | Wigler et al. |
| 5,830,645 | A | 11/1998 | Pinkel et al. |
| 5,837,196 | A | 11/1998 | Pinkel et al. |
| 5,982,534 | A | 11/1999 | Pinkel et al. |
| 6,146,593 | A | 11/2000 | Pinkel et al. |
| 6,210,878 | B1 | 4/2001 | Pinkel et al. |
| 6,326,148 | B1 | 12/2001 | Pauletti et al. |
| 6,350,576 | B1 | 2/2002 | Wigler et al. |
| 6,417,506 | B1 | 7/2002 | Pinkel et al. |
| 6,455,258 | B2 | 9/2002 | Bastian et al. |
| 6,465,182 | B1 | 10/2002 | Gray et al. |
| 6,562,565 | B1 | 5/2003 | Pinkel et al. |
| 6,664,057 | B2 | 12/2003 | Albertson et al. |
| 2002/0142305 | A1 | 10/2002 | Chin et al. |
| 2003/0091994 | A1 | 5/2003 | Jenkins et al. |
| 2003/0215936 | A1* | 11/2003 | Kallioniemi et al. ...... 435/287.1 |
| 2008/0242742 | A1* | 10/2008 | Depinho et al. ............. 514/789 |

OTHER PUBLICATIONS

DePreter et al (2002) Mod. Pathol. vol. 15(2): 159-66.*
Jen et al. (1994) The New England Journal of Medicine vol. 331 No. 4 pp. 213-221.*
Hartmann et al. (2002) Cancer Research vol. 62: pp. 4100-4108.*
Pohl et al. (2000) Genomics vol. 63: pp. 255-262.*
Logsdon et al. (2003) Cancer Research 63: pp. 2649-2657.*
Table 2 of Depinho et al. from U.S. Appl. No. 11/503,499, filed Aug. 11, 2006.*
Aguirre et al. (Jun. 15, 2004) PNAS vol. 101 No. 24 pp. 9067-9072.*
Balsara et al., Comparative genomic hybridization and loss of heterozygosity analyses identify a common region of deletion at 15q11.1-15 in human malignant mesothelioma, Cancer Research, 1999, vol. 59, pp. 450-454.
Bello et al., High-Resolution analysis of chromosome Arm 1p alterations in meningioma, Cancer Genet Cytogenet, 2000, vol. 120, pp. 30-36.
Fukuda et al., CD44 is a potential target of amplification within the 11p13 amplicon detected in gastric cancer cell lines, Genes, Chromosomes & Cancer. 2000, vol. 29, pp. 315-324.
Koga et al., Frequent genomic imbalances in chromosomes 17, 19 and 22q in peripheral nerve sheath tumors detected by comparative genomic hybridization analysis, J. Pathology, 2002, vol. 197, pp. 98-107.
O'Leary et al., Loss of heterozygosity at 1p36 predicts poor prognosis in gastrointestinal stromal/smooth muscle tumors, Laboratory Investigation. 1999, vol. 79, No. 12, pp. 1461-1467.
Matsumoto et al., Molecular cloning and characterization of the human NUDC gene. Hum. Genet. 1999, vol. 104, p. 498-504.
Smedley et al., Characterization of chromosome 1 abnormalities in malignant melanomas, Genes, Chromosomes, Cancer, 2000, vol. 28, pp. 121-125.
Watnick et al., Quantitative mapping of amplicon structure by array CGH identifies CYP24 as a candidate oncogene, Nature Genetics, 2000, vol. 25, pp. 144-146.
International Search Report dated Aug. 21, 2008 from PCT/US05/18850.
Abe, T., et al., "Identification of Three Commonly Deleted Regions on Chromosome Arm 6q in Human Pancreatic Cancer," Genes Chromosomes Cancer 25:60-4 (1999).
Akagi, K., et al., "RTCGD: retroviral tagged cancer gene database," Nucl. Acids Res. 32:D523-D527 (2004).
Albertson, D. G., et al., "Quantitative mapping of amplicon structure by array CGH identifies CYP24 as a candidate oncogene," Nature Genetics 25, 144-146 (2000).

(Continued)

*Primary Examiner* — Suchira Pande
(74) *Attorney, Agent, or Firm* — Foley Hoag LLP

(57) ABSTRACT

The invention relates to compositions, kits, and methods for detecting, characterizing, preventing, and treating human pancreatic adenocarcinoma. A variety of chromosomal regions (MCRs) and markers in the MCRs, are provided that are correlated with cancer. In particular, chromosomal regions and markers in the MCR 50.06-62.89 Mb of human chromosome 19, are provided, wherein alterations in the copy number of the MCR and/or alterations in the amount, structure, and/or activity of one or more of the markers in the MCR is correlated with the presence of pancreatic adenocarcinoma.

3 Claims, 6 Drawing Sheets

(56) References Cited

OTHER PUBLICATIONS

Armengol, G., et al., "DNA Copy Number Changes and Evaluation of MYC, IGF1R, and FES Amplification in Xenografts of Pancreatic Adenocarcinoma," Cancer Genet. Cytogenet. 116: 133-141 (2000).
Balmain, A. et al., "The genetics and genomics of cancer," Nat. Genet. 33:238-244 (2003).
Bardi, G., et al., "Karyotypic abnormalities in tumours of the pancreas," Br J Cancer 67:1106-1112 (1993).
Baylin, S. and Bestor, T.H., "Altered methylation patterns in cancer cell genomes: Cause or consequence?," Cancer Cell 1:299-305 (2002).
Bernard, P.S. and Wittwer, C.T., "Real-Time PCR Technology for Cancer Diagnostics," Clin. Chem. 48(8):1178-1185 (2002).
Brennan, C. et al., "High-Resolution Global Profiling of Genomic Alterations with Long Oligonucleotide Microarray," Cancer Res. 64(14):4744-4748 (2004).
Caldas, C., et al., "Frequent somatic mutations and homozygous deletions of the p16 (MTS1) gene in pancreatic adenocarcinoma," Nature Genetics 8:27-32 (1994).
Collins, C. et al., "Comprehensive Genome Sequence Analysis of a Breast Cancer Amplicon," Genome Res. 11(6):1034-1042 (2001).
Conrads, T. P. et al., "Utility of Accurate Mass Tags for Proteome-Wide Protein Identification," Anal. Chem. 72:3349-3354 (2000).
Curtis, L. J., et al., "Amplification of DNA Sequences from Chromosome 19q13.1 in Human Pancreatic Cell Lines," Genomics 53:42-55 (1998).
Davies et al., "Mutations of the BRAF gene in human cancer," Nature 417(6892):949-954 (2002).
Fukushige, S., et al., "Frequent Gain of Copy Number on the Long Arm of Chromosome 20 in Human Pancreatic Adenocarcinoma," Genes Chromosomes Cancer 19:161-9 (1997).
Furukawa, T., et al., "Potential Tumor Suppressive Pathway Involving DUSP6/NKP-3 in Pancreatic Cancer," Am J Pathology 162:1807-15 (2003).
Ghadimi, B. M., et al., "Specific Chromosomal Aberrations and Amplification of the AIB1 Nuclear Receptor Coactivator Gene in Pancreatic Carcinomas," Am. J. Pathol. 154:525-36 (1999).
Ginzinger, D. G. "Gene quantification using real-time quantitative PCR: An emerging technology hits the mainstream," Exp. Hematol. 30:503-512 (2002).
Ginzinger, D. G. et al., "Measurement of DNA Copy Number at Microsatellite Loci Using Quantitative PCR Analysis," Cancer Res. 60:5405-5409 (2000).
Golub, T. R., et al., "Molecular Classification of Cancer: Class Discovery and Class Prediction by Gene Expression Monitoring," Science 286:531-537 (1999).
Gorunova, L., et al., "Cytogenetic Analysis of Pancreatic Carcinomas: Intratumor Heterogeneity and Nonrandom Pattern of Chromosome Aberrations," Genes Chromosomes Cancer 23:81-99 (1998).
Gorunova, L., et al., "Massive Cytogenetic Heterogeneity in a Pancreatic Carcinoma: Fifty-Four Karyotypically Unrelated Clones," Genes Chromosomes Cancer 14:259-266 (1995).
Gray, J. W. and Collins, C., "Genome changes and gene expression in human solid tumors," Carcinogenesis 21(3):443-452 (2000).
Gray, J. W. et al., "Specific Keynote: Genome Copy Number Abnormalities in Ovarian Cancer," Gyn. Oncol. 88:S16-S21 (2003).
Griffin, C. A., et al., "Chromosome Abnormalities in Pancreatic Adenocarcinoma," Genes Chromosomes Cancer 9:93-100 (1994).
Griffin, C. A., et al., "Consistent Chromosome Abnormalities in Adenocarcinoma of the Pancreas," Cancer Res. 55:2394-2399 (1995).
Hahn, S. A., et al., "Allelotype of Pancreatic Adenocarcinoma Using Xenograft Enrichment," Cancer Res. 55:4670-4675 (1995).
Hyman, E., et al., "Impact of DNA Amplification on Gene Expression Patterns in Breast Cancer," Cancer Res. 62:6240-6245 (2002).
Iwabuchi, H. et al., "Genetic Analysis of Benign, Low-Grade, and High-Grade Ovarian Tumors," Cancer Res. 55:6172-6180 (1995).
Jaenisch, R. and Bird, A., "Epigenetic regulation of gene expression: how the genome integrates intrinsic and environmental signals," Nature Genetics, 33:245-254 (2003).
Johansson, B., et al., "Nonrandom Chromosomal Rearrangements in Pancreatic Carcinomas," Cancer 69:1674-1681 (1992).
Jones, P. A. and Baylin, S. B., "The Fundamental Role of Epigenetic Events in Cancer," Nat. Rev. Genet. 3(6):415-428 (2002).
Kallioniemi, A. et al., "Comparative Genomic Hybridization for Molecular Cytogenetic Analysis of Solid Tumors," Science 258:818-821 (1992).
Kawasaki, K. et al., "11q23-24 loss is associated with chromosomal instability in endometrial cancer," Int. J. Mol. Med. 12(5):727-731 (2003).
Kimura, M., et al., "Detailed Deletion Mapping on Chromosome Arm 12q in Human Pancreatic Adenocarcinoma: Identification of a 1-cM Region of Common Allelic Loss," Genes Chromosomes Cancer 17:88-93 (1996).
Kimura Y, et al., "Genetic alterations in 102 primary gastric cancers by comparative genomic hybridization: gain of 20q and loss of 18q are associated with tumor progression," Mod. Pathol., 17:1328-1337 (2004).
Laird, C. D. et al., "Hairpin-bisulfite PCR: Assessing epigenetic methylation patterns on complementary strands of individual DNA molecules," Proc. Natl. Acad. Sci. USA 101(1):204-209 (2004).
Laird, P. W. and Jaenisch, R., "DNA methylation and cancer," Hum. Mol. Genet. 3:1487-1495 (1994).
Laird, P. W., "Mouse Models in DNA-Methylation Research," Curr. Top. Microbiol. Immunol. 249:119-134 (2000).
Laird, P. W., "Oncogenic mechanisms mediated by DNA methylation," Mol. Med. Today 3(5):223-229 (1997).
Laird, P. W., "The Power and the Promise of DNA Methylation Markers," Nat. Rev. Cancer 3(4):253-266 (2003).
Lapuk et al., "Computational BAC Clone Contig Assembly for Comprehensive Genome Analysis," Genes Chrom. Cancer 40:66-71 (2004).
Lisitsyn, N. et al., "Cloning the Differences Between Two Complex Genomes," Science 259:946-951 (1993).
Lucito, R., et al., "Representational Oligonucleotide Microarray Analysis: A High-Resolution Method to Detect Genome Copy Number Variation," Genome Res. 13,2291-305 (2003).
Mahlamaki, E. H., et al., "Comparative Genomic Hybridization Reveals Frequent Gains of 20q, 8q, 11q, 12q, and 17q, and Losses of 18q, 9q, and 15q in Pancreatic Cancer," Genes Chromosomes Cancer 20:383-91 (1997).
Mahlamaki, E. H., et al., "Frequent Amplification of 8q24, 11q, 17q, and 20q-Specific Genes in Pancreatic Cancer," Genes Chromosomes Cancer 35:353-358 (2002).
Neil, J. C. & Cameron, E. R., "Retroviral insertion sites and cancer: Fountain of all knowledge?," Cancer Cell 2:253-255 (2002).
Nilsson, M. et al., "Amplification of Chromosome 1 Sequences in Lipomatous Tumors and Other Sarcomas," Int. J. Cancer 109(3):363-369 (2004).
Olshen, A. B., and Venkatraman, E. S., "Change-Point Analysis of Array-Based Comparative Genomic Hybridization Data," ASA Proceedings of the Joint Statistical Meetings 2530-2535 (2002).
Pinkel, D. et al., "High resolution analysis of DNA copy number variation using comparative genomic hybridization to microarrays," Nature Genetics 20:207-211 (1998).
Platzer, P., et al., "Silence of Chromosomal Amplifications in Colon Cancer," Cancer Res. 62:1134-1138 (2002).
Pollack, J. R., et al., "Genome-wide analysis of DNA copy-number changes using cDNA microarrays," Nat. Genet. 23:41-46 (1999).
Pollack, J. R., et al., "Microarray analysis reveals a major direct role of DNA copy number alteration in the transcriptional program of human breast tumors," Proc. Natl. Acad. Sci. USA 99(20):12963-12968 (2002).
Rozenblum, E., et al., "Tumor-suppressive Pathways in Pancreatic Carcinoma," Cancer Res. 57:1731-1734 (1997).
Schena, M. et al., "Quantitative Monitoring of Gene Expression Patterns with a Complementary DNA Microarray," Science 270:467-470 (1995).

(56) References Cited

OTHER PUBLICATIONS

Seymour, A. B., et al., "Allelotype of Pancreatic Adenocarcinoma," Cancer Res. 54: 2761-2764 (1994).

Solinas-Toldo, S., et al., "Mapping of Chromosomal Imbalances in Pancreatic Carcinoma by Comparative Genomic Hybridization," Cancer Res. 56:3803-3807 (1996).

Suzuki, S. et al., "An Approach to Analysis of Large-Scale Correlations between Genome Changes and Clinical Endpoints in Ovarian Cancer," Cancer Res. 60(19):5382-5385 (2000).

Volik, S., "End-sequence profiling: Sequence-based analysis of aberrant genomes," Proc. Natl. Acad. Sci. USA 100(13):7696-7701 (2003).

Wang Z. C. et al., "Loss of Heterozygosity and Its Correlation with Expression Profiles in Subclasses of Invasive Breast Cancers," Cancer Res 64(1):64-71 (2004).

Wolf, M et al., "High-Resolution Analysis of Gene Copy Number Alterations in Human Prostate Cancer Using CGH on cDNA Microarrays: Impact of Copy Number on Gene Expression," Neoplasia 6(3):240-247 (2004).

Zardo, G. et al., "Integrated genomic and epigenomic analyses pinpoint biallelic gene inactivation in tumors," Nat. Genet. 32(3):453-458 (2002).

Zhao et al., "An Integrated View of Copy Number and Allelic Alterations in the Cancer Genome Using Single Nucleotide Polymorphism Arrays," Cancer Res. 64:3060-3071 (2004).

* cited by examiner

COMPOSITIONS, KITS, AND METHODS FOR IDENTIFICATION, ASSESSMENT, PREVENTION AND TREATMENT OF PANCREATIC ADENOCARCINOMA IN HUMANS

CROSS REFERENCE TO RELATED APPLICATIONS

This application claims priority to U.S. Provisional Application No. 60/575,795, which was filed on May 28, 2004 and U.S. Provisional Application No. 60/580,337, which was filed on Jun. 15, 2004, both of which are hereby incorporated by refemce in there entirety.

GOVERNMENT FUNDING

Work described herein was supported, at least in part, by National Institutes of Health (NIH) under grant RO1CA99041, R01CA86379, R01CA84628, and T32 CA09382. The government may therefore have certain rights to this invention.

BACKGROUND OF THE INVENTION

Cancer represents the phenotypic end-point of multiple genetic lesions that endow cells with a full range of biological properties required for tumorigenesis. Indeed, a hallmark genomic feature of many cancers, including, for example, pancreatic cancer, breast cancer, ovarian cancer, and colon cancer, is the presence of numerous complex chromosome structural aberrations—including non-reciprocal translocations, amplifications and deletions.

Karyotype analyses (Johansson, B., et al. (1992) *Cancer* 69, 1674-81; Bardi, G., et al. (1993) *Br J Cancer* 67, 1106-12; Griffin, C. A., et al. (1994) *Genes Chromosomes Cancer* 9, 93-100; Griffin, C. A., et al. (1995) *Cancer Res* 55, 2394-9; Gorunova, L., et al. (1995) *Genes Chromosomes Cancer* 14, 259-66; Gorunova, L., et al. (1998) *Genes Chromosomes Cancer* 23, 81-99), chromosomal CGH and array CGH (Wolf M et al. (2004) *Neoplasia* 6 (3) 240; Kimura Y, et al. (2004) *Mod. Pathol.* 21 May (epub); Pinkel, et al. (1998) *Nature Genetics* 20:211; Solinas-Toldo, S., et al. (1996) *Cancer Res* 56, 3803-7; Mahlamaki, E. H., et al. (1997) *Genes Chromosomes Cancer* 20, 383-91; Mahlamaki, E. H., et al. (2002) *Genes Chromosomes Cancer* 35, 353-8; Fukushige, S., et al. (1997) *Genes Chromosomes Cancer* 19:161-9; Curtis, L. J., et al. (1998) *Genomics* 53, 42-55; Ghadimi, B. M., et al. (1999) *Am J Pathol* 154, 525-36; Armengol, G., et al. (2000) *Cancer Genet Cytogenet* 116, 133-41), fluorescence in situ hybridization (FISH) analysis (Nilsson M et al. (2004) *Int J Cancer* 109(3):363-9; Kawasaki K et al. (2003) *Int J Mol. Med.* 12(5):727-31) and loss of heterozygosity (LOH) mapping (Wang Z C et al. (2004) *Cancer Res* 64(1):64-71; Seymour, A. B., et al. (1994) *Cancer Res* 54, 2761-4; Hahn, S. A., et al. (1995) *Cancer Res* 55, 4670-5; Kimura, M., et al. (1996) *Genes Chromosomes Cancer* 17, 88-93) have identified recurrent regions of copy number change or allelic loss in various cancers. For example, in pancreatic cancer, frequent gains have been mapped to 3q, 5p, 7p, 8q, 11q, 12p, 17q and 20q and losses to 3p, 4q, 6q, 8p, 9p, 10q, 12q, 13q, 17p, 18q and 21q and 22q. In some instances, validated oncogenes and tumor suppressor genes residing within these loci have been identified, including MYC (8q24), $p^{INK4A}$ (9p21), p53 (17p13), SMAD4 (18q21) and AKT2 (19q13). However, for the majority of amplified and deleted loci and resident genes, the presumed cancer-relevant targets remain to be discovered.

SUMMARY OF THE INVENTION

The present invention is based, at least in part, on the identification of specific regions of the genome (referred to herein as minimal common regions (MCRs)), of recurrent copy number change which are contained within certain chromosomal regions (loci) and are associated with cancer. These MCRs were identified using a novel cDNA or oligomer-based platform and bioinformatics tools which allowed for the high-resolution characterization of copy-number alterations in the pancreatic adenocarcinoma genome (see Example 1). The present invention is based, also in part, on the identification of markers residing within the MCRs of the invention, which are also associated with cancer.

Accordingly, in one aspect, the present invention provides methods of assessing whether a subject is afflicted with cancer or at risk for developing cancer, comprising comparing the copy number of an MCR in a subject sample to the normal copy number of the MCR, wherein the MCR is selected from the group consisting of the MCRs listed in Table 1, and wherein an altered copy number of the MCR in the sample indicates that the subject is afflicted with cancer or at risk for developing cancer. In one embodiment, the copy number is assessed by fluorescent in situ hybridization (FISH). In another embodiment, the copy number is assessed by quantitative PCR (qPCR). In still another embodiment, the normal copy number is obtained from a control sample. In yet another embodiment, the sample is selected from the group consisting of tissue, whole blood, serum, plasma, buccal scrape, saliva, cerebrospinal fluid, urine, stool, bile, pancreatic juice, and pancreatic tissue.

In another aspect, the invention provides methods of assessing whether a subject is afflicted with cancer or at risk for developing cancer comprising comparing the amount, structure, and/or activity of a marker in a subject sample, wherein the marker is a marker which resides in an MCR listed in Table 1, and the normal amount, structure, and/or activity of the marker, wherein a significant difference between the amount, structure, and/or activity of the marker in the sample and the normal amount, structure, and/or activity is an indication that the subject is afflicted with cancer or at risk for developing cancer. In one embodiment, the marker is selected from the group consisting of the markers listed in Table 4 or Table 5. In another embodiment, the amount of the marker is determined by determining the level of expression of the marker. In yet another embodiment, the level of expression of the marker in the sample is assessed by detecting the presence in the sample of a protein corresponding to the marker. The presence of the protein may be detected using a reagent which specifically binds with the protein. In one embodiment, the reagent is selected from the group consisting of an antibody, an antibody derivative, and an antibody fragment. In another embodiment, the level of expression of the marker in the sample is assessed by detecting the presence in the sample of a transcribed polynucleotide or portion thereof, wherein the transcribed polynucleotide comprises the marker. In one embodiment, the transcribed polynucleotide is an mRNA or cDNA. The level of expression of the marker in the sample may also be assessed by detecting the presence in the sample of a transcribed polynucleotide which anneals with the marker or anneals with a portion of a polynucleotide wherein the polynucleotide comprises the marker, under stringent hybridization conditions.

In another embodiment, the amount of the marker is determined by determining copy number of the marker. The copy number of the MCRs or markers may be assessed by comparative genomic hybridization (CGH), e.g., array CGH. In still another embodiment, the normal amount, structure, and/or activity is obtained from a control sample. In yet another embodiment, the sample is selected from the group consisting of tissue, whole blood, serum, plasma, buccal scrape, saliva, cerebrospinal fluid, urine, stool, bile, pancreatic juice, and pancreatic tissue.

In another aspect, the invention provides methods for monitoring the progression of cancer in a subject comprising a) detecting in a subject sample at a first point in time, the amount and/or activity of a marker, wherein the marker is a marker which resides in an MCR listed in Table 1; b) repeating step a) at a subsequent point in time; and c) comparing the amount and/or activity detected in steps a) and b), and therefrom monitoring the progression of cancer in the subject. In one embodiment, the marker is selected from the group consisting of the markers listed in Table 4 or Table 5. In another embodiment, the sample is selected from the group consisting of tissue, whole blood, serum, plasma, buccal scrape, saliva, cerebrospinal fluid, urine, stool, bile, pancreatic juice, and pancreatic tissue. In still another embodiment, the sample comprises cells obtained from the subject. In yet another embodiment, between the first point in time and the subsequent point in time, the subject has undergone treatment for cancer, has completed treatment for cancer, and/or is in remission.

In still another aspect, the invention provides methods of assessing the efficacy of a test compound for inhibiting cancer in a subject comprising comparing the amount and/or activity of a marker in a first sample obtained from the subject and maintained in the presence of the test compound, wherein the marker is a marker which resides in an MCR listed in Table 1, and the amount and/or activity of the marker in a second sample obtained from the subject and maintained in the absence of the test compound, wherein a significantly higher amount and/or activity of a marker in the first sample which is deleted in cancer, relative to the second sample, is an indication that the test compound is efficacious for inhibiting cancer, and wherein a significantly lower amount and/or activity of the marker in the first sample which is amplified in cancer, relative to the second sample, is an indication that the test compound is efficacious for inhibiting cancer in the subject. In one embodiment, the first and second samples are portions of a single sample obtained from the subject. In another embodiment, the first and second samples are portions of pooled samples obtained from the subject. In one embodiment, the marker is selected from the group consisting of the markers listed in Table 4 or Table 5.

In yet another aspect, the invention provides methods of assessing the efficacy of a therapy for inhibiting cancer in a subject comprising comparing the amount and/or activity of a marker in the first sample obtained from the subject prior to providing at least a portion of the therapy to the subject, wherein the marker is a marker which resides in an MCR listed in Table 1, and the amount and/or activity of the marker in a second sample obtained from the subject following provision of the portion of the therapy, wherein a significantly higher amount and/or activity of a marker in the first sample which is deleted in cancer, relative to the second sample, is an indication that the test compound is efficacious for inhibiting cancer and wherein a significantly lower amount and/or activity of a marker in the first sample which is amplified in cancer, relative to the second sample, is an indication that the therapy is efficacious for inhibiting cancer in the subject. In one embodiment, the marker is selected from the group consisting of the markers listed in Table 4 or Table 5.

Another aspect of the invention provides methods of selecting a composition capable of modulating cancer comprising obtaining a sample comprising cancer cells; contacting said cells with a test compound; and determining the ability of the test compound to modulate the amount and/or activity of a marker, wherein the marker is a marker which resides in an MCR listed in Table 1, thereby identifying a modulator of cancer. In one embodiment, the marker is selected from the group consisting of the markers listed in Table 4 or Table 5. The cells may be isolated from, e.g., an animal model of cancer, a cancer cell line, e.g., a pancreatic cancer cell line originating from a pancreatic tumor, or from a subject suffering from cancer.

Yet another aspect of the invention provides methods of selecting a composition capable of modulating cancer comprising contacting a marker with a test compound; and determining the ability of the test compound to modulate the amount and/or activity of a marker, wherein the marker is a marker which resides in an MCR listed in Table 1, thereby identifying a composition capable of modulating cancer. In one embodiment, the marker is selected from the group consisting of the markers listed in Table 4 or Table 5. In another embodiment, the method further comprises administering the test compound to an animal model of cancer. In still another embodiment, the modulator inhibits the amount and/or activity of a gene or protein corresponding to a marker set forth in Table 1 which is amplified, e.g., a marker selected from the markers listed in Table 5. In yet another embodiment, the modulator increases the amount and/or activity of a gene or protein corresponding to a marker set forth in Table 1 which is deleted, e.g., a marker selected from the markers listed in Table 4.

In another aspect, the invention provides kits for assessing the ability of a compound to inhibit cancer comprising a reagent for assessing the amount, structure, and/or activity of a marker, wherein the marker is a marker which resides in an MCR listed in Table 1. In one embodiment, the marker selected from the group consisting of the markers listed in Table 4 or Table 5.

The invention also provides kits for assessing whether a subject is afflicted with cancer comprising a reagent for assessing the copy number of an MCR selected from the group consisting of the MCRs listed in Table 1, as well as kits for assessing whether a subject is afflicted with cancer, the kit comprising a reagent for assessing the amount, structure, and/or activity of a marker. In one embodiment, the marker selected from the group consisting of the markers listed in Table 4 or Table 5.

In another aspect, the invention provides kits for assessing the presence of human cancer cells comprising an antibody or fragment thereof, wherein the antibody or fragment thereof specifically binds with a protein corresponding to a marker, wherein the marker is a marker which resides in an MCR listed in Table 1. In one embodiment, the marker selected from the group consisting of the markers listed in Table 4 or Table 5.

In still another aspect, the invention provides kits for assessing the presence of cancer cells comprising a nucleic acid probe wherein the probe specifically binds with a transcribed polynucleotide corresponding to a marker, wherein the marker is a marker which resides in an MCR listed in Table 1. In one embodiment, the marker selected from the group consisting of the markers listed in Table 4 or Table 5.

In yet another aspect, the invention provides methods of treating a subject afflicted with cancer comprising administering to the subject a modulator of the amount and/or activity of a gene or protein corresponding to a marker, wherein the marker is a marker which resides in an MCR listed in Table 1. In one embodiment, the marker selected from the group consisting of the markers listed in Table 4 or Table 5.

The invention also provides methods of treating a subject afflicted with cancer comprising administering to the subject a compound which inhibits the amount and/or activity of a gene or protein corresponding to a marker which resides in an MCR listed in Table 1 which is amplified in cancer, e.g., a marker selected from the markers listed in Table 5, thereby treating a subject afflicted with cancer. In one embodiment, the compound is administered in a pharmaceutically acceptable formulation. In another embodiment, the compound is an antibody or an antigen binding fragment thereof, which specifically binds to a protein corresponding to the marker. For example, the antibody may be conjugated to a toxin or a chemotherapeutic agent. In still another embodiment, the compound is an RNA interfering agent, e.g., an siRNA molecule or an shRNA molecule, which inhibits expression of a gene corresponding to the marker. In yet another embodiment, the compound is an antisense oligonucleotide complementary to a gene corresponding to the marker. In still another embodiment, the compound is a peptide or peptidomimetic, a small molecule which inhibits activity of the marker, e.g., a small molecule which inhibits a protein-protein interaction between a marker and a target protein, or an aptamer which inhibits expression or activity of the marker.

In another aspect, the invention provides methods of treating a subject afflicted with cancer comprising administering to the subject a compound which increases expression or activity of a gene or protein corresponding to a marker which resides in an MCR listed in Table 1 which is deleted in cancer, e.g., a marker selected from the markers listed in Table 4, thereby treating a subject afflicted with cancer. In one embodiment, the compound is a small molecule.

The invention also includes methods of treating a subject afflicted with cancer comprising administering to the subject a protein corresponding to a marker, e.g., a marker selected from the markers listed in Table 4, thereby treating a subject afflicted with cancer. In one embodiment, the protein is provided to the cells of the subject, by a vector comprising a polynucleotide encoding the protein. In still another embodiment, the compound is administered in a pharmaceutically acceptable formulation.

The present invention also provides isolated proteins, or fragments thereof, corresponding to a marker selected from the markers listed in Table 4 or Table 5.

In another aspect, the invention provides isolated nucleic acid molecules, or fragments thereof, corresponding to a marker selected from the markers listed in Table 4 or Table 5.

In still another aspect, the invention provides isolated antibodies, or fragments thereof, which specifically bind to a protein corresponding to a marker selected from the markers listed in Table 4 or Table 5.

In yet another aspect, the invention provides an isolated nucleic acid molecule, or fragment thereof, contained within an MCR listed in the MCRs listed in Table 1, wherein said nucleic acid molecule has an altered amount, structure, and/or activity in cancer. The invention also provides an isolated polypeptide encoded by the nucleic acid molecules.

DETAILED DESCRIPTION OF THE INVENTION

Figure 1:
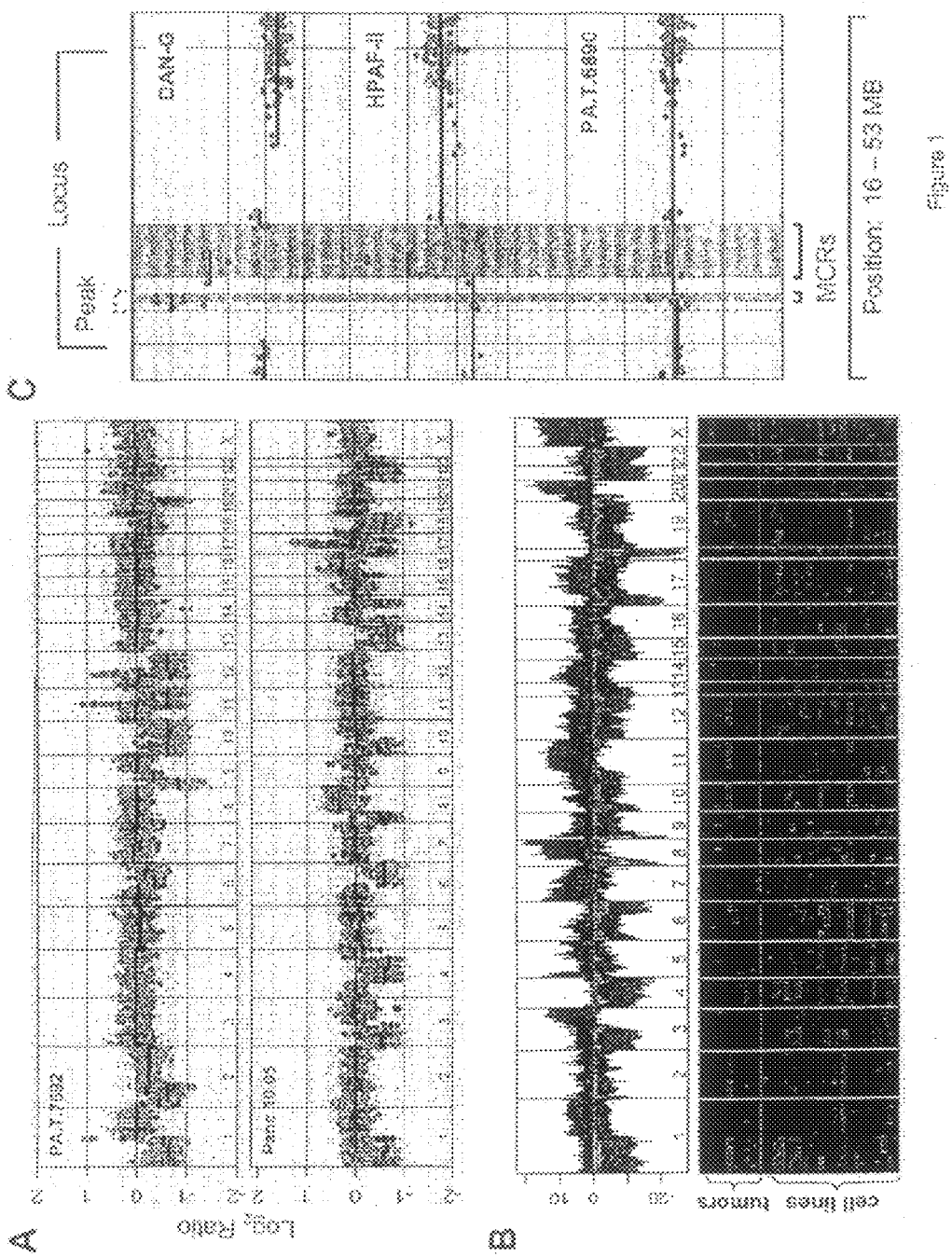
FIGS. 1A-1C depict the genomic profiles from pancreatic adenocarcinoma samples. Array-CGH profiles with x-axis coordinates representing cDNA probes ordered by genomic map positions. Segmented data is displayed in red, median filtered (3 nearest neighbors) in blue and raw data in black. (1A) Whole-genome profiles of primary tumor specimen PA.T.7692 (top) and cell line Panc 10.05 (bottom). Note the presence of focal high-level amplifications and deletions as well as large regional gains and losses in both samples. (1B) Recurrence of chromosomal alterations. Top: Integer-value recurrence of CNAs in segmented data (Y-axis) plotted for each cDNA probe evenly aligned along the x-axis in genome order. Dark red or green bars denote gain or loss of chromosome material. Bright red or green bars represent probes within regions of amplification or deletion. Bottom: TreeView showing discrete CNAs within all samples. Red represents chromosomal gain and green denotes chromosomal loss. (1C) CGH profiles of 12p12.3-q13.3 locus (Locus # 15 of Table 1) in three samples illustrating the definition of the physical extent, peak profile and MCRs for that locus. Note that the left MCR is defined by the overlap between samples on top and bottom, while the right MCR is defined by the overlap between the two samples on top. Since data points are plotted on the x-axis by genomic map positions, gaps in the profiles encompass regions of copy number transition for which there is no data point.

The present invention is based, at least in part, on the identification of specific regions of the genome (referred to herein as minimal common regions (MCRs)), of recurrent copy number change which are contained within certain chromosomal regions (loci) and are associated with cancer. These MCRs were identified using a novel cDNA or oligomer-based platform and bioinformatics tools which allowed for the high-resolution characterization of copy-number alterations in the pancreatic adenocarcinoma genome (see Example 1).

To arrive at the identified loci and MCRs, array comparative genomic hybridization (array-CGH) was utilized to define copy number aberrations (CNAs) (gains and losses of chromosomal regions) in pancreatic adenocarcinoma cell lines and tumor specimens.

Segmentation analysis of the raw profiles to filter noise from the dataset (as described by Olshen and Venkatraman, Olshen, A. B., and Venkatraman, E. S. (2002) *ASA Proceedings of the Joint Statistical Meetings* 2530-2535; Ginzinger, D. G. (2002) *Exp Hematol* 30, 503-12; Golub, T. R., et al. (1999) *Science* 286, 531-7; Hyman, E., et al. (2002) *Cancer Res* 62, 6240-5; Lucito, R., et al. (2003) *Genome Res* 13, 2291-305) was performed and used to identify statistically significant changepoints in the data.

Identification of loci was based on an automated computer algorithm that utilized several basic criteria as follows: 1) segments above or below certain percentiles were identified as altered; 2) if two or more altered segments were adjacent in a single profile separated by less than 500KB, the entire region spanned by the segments was considered to be an altered span; 3) highly altered segments or spans that were shorter than 20 MB were retained as "informative spans" for defining discrete locus boundaries. Longer regions were not discarded, but were not included in defining locus boundaries; 4) informative to spans were compared across samples to identify overlapping groups of positive-value or negative-value segments; each group defines a locus; and 5) MCRs were defined as contiguous spans having at least 75% of the peak recurrence as calculated by counting the occurrence of highly altered segments. If two MCRs were separated by a gap of only one probe position, they were joined. If there were more than 3 MCRs in a locus, the whole region was reported as a single complex MCR.

A locus-identification algorithm was used that defines informative CNAs on the basis of size and achievement of a high significance threshold for the amplitude of change. Overlapping CNAs from multiple profiles were then merged in an automated fashion to define a discrete "locus" of regional copy number change, the bounds of which represent the combined physical extend to these overlapping CNAs (FIG. 1C). Each locus was characterized by a peak profile, the width and amplitude of which reflect the contour of the most prominent amplification or deletion for that locus. Furthermore, within each locus, one or more minimal common regions (MCRs) were identified across multiple tumor samples (FIG. 1C), with each MCR potentially harboring a distinct cancer-relevant gene targeted for copy number alteration across the sample set.

The locus-identification algorithm defined discrete MCRs within the dataset which were annotated in terms of recurrence, amplitude of change and representation in both cell lines and primary tumors. These discrete MCRs were prioritized based on four criteria that emphasize recurrent high-threshold changes in both primary tumors and cell lines (see Example 1). Implementation of this prioritization scheme yielded 64 MCRs of the present invention within 54 independent loci, that satisfied at least three of the four criteria (see Table 1).

The confidence-level ascribed to these prioritized loci was further validated by real-time quantitative PCR (QPCR), which demonstrated 100% concordance with 16 selected MCRs defined by array-CGH. When the MCRs in Table 1 were combined with an additional 81 MCRs (within 66 distinct loci) satisfying 2 out of 4 criteria, this genomic characterization has produced a set of 145 MCRs within 121 independent loci (Table 3).

The MCRs identified herein possess a median size of 2.7 Mb, with 21 (33%) MCRs spanning 1 Mb or less (median of 0.33 Mb) and possess an average of 15 annotated genes. Table 1 lists the cytogenetic bands for each of the 54 independent loci as well as the locus boundary (Mb) and locus peak profile. The positions of each of the identified MCRs are also listed in Table 1, as well as the size and recurrence for each. For example, locus #3 represents a chromosomal region of 5q31.1-q31.1 and has a locus boundary of 133.51-134.33. This locus contains an MCR at position 133.53-133.56.

Also in Table 1, the loci and MCRs are indicated as having either "gain and amplification" or "loss and deletion," indicating that each locus and MCR has either (1) increased copy number and/or expression or (2) decreased copy number and/or expression, or deletion, in cancer. Furthermore, genes known to play important roles in the pathogenesis of pancreatic adenocarcinoma (the p16$^{INK4A}$ and TP53 tumor suppressors and the MYC, KRAS2 and AKT2 oncogenes) are present within the loci and are also set forth in Table 1.

Complementary expression profile analysis of a significant fraction of the genes residing within the MCRs of the present invention provided a subset of markers with statistically significant association between gene dosage and mRNA expression. Table 4 lists the markers of the invention which reside in MCRs of deletion and which consequently display decreased expression by comparison across pancreatic cancer cell lines. Table 5 lists the markers of the invention which reside in MCRs of amplification that are overexpressed by comparison, across pancreatic cancer cell lines. Additional markers within the MCRs that have not yet been annotated may also be used as markers for cancer as described herein, and are included in the invention.

The novel methods for identifying chromosomal regions of altered copy number, as described herein, may be applied to various data sets for various diseases, including, but not limited to, cancer. Other methods may be used to determine copy number aberrations as are known in the art, including, but not limited to oligonucleotide-based microarrays (Brennan, et al. (2004) *In Press;* Lucito, et al. (2003) *Genome Res.* 13:2291-2305; Bignell et al. (2004) *Genome Res.* 14:287-295; Zhao, et al (2004) *Cancer Research, In Press*), and other methods as described herein including, for example, hybridization methods (FISH).

The amplification or deletion of the MCRs identified herein correlate with the presence of cancer, e.g., pancreatic cancer and other epithelial cancers. Furthermore, analysis of copy number and/or expression levels of the genes residing within each MCR has led to the identification of individual markers and combinations of markers described herein, the increased and decreased expression and/or increased and decreased copy number of which correlate with the presence of cancer, e.g., pancreatic cancer, e.g., in a subject.

Accordingly, methods are provided herein for detecting the presence of cancer in a sample, the absence of cancer in a sample, and other characteristics of cancer that are relevant to prevention, diagnosis, characterization, and therapy of cancer in a subject by evaluating alterations in the amount, structure, and/or activity of a marker. For example, evaluation of the presence, absence or copy number of the MCRs identified herein, or by evaluating the copy number, expression level, protein level, protein activity, presence of mutations (e.g., substitution, deletion, or addition mutations) which affect activity of the marker, or methylation status of any one or more of the markers within the MCRs (e.g., the markers set forth in Tables 4 and 5), is within the scope of the invention.

Methods are also provided herein for the identification of compounds which are capable of inhibiting cancer, in a subject, and for the treatment, prevention, and/or inhibition of cancer using a modulator, e.g., an agonist or antagonist, of a gene or protein marker of the invention.

Although the MCRs and markers described herein were identified in pancreatic cancer samples, the methods of the invention are in no way limited to use for the prevention, diagnosis, characterization, therapy and prevention of pancreatic cancer, e.g., the methods of the invention may be applied to any cancer, as described herein.

Various aspects of the invention are described in further detail in the following subsections:

I. Definitions

As used herein, each of the following terms has the meaning associated with it in this section.

The articles "a" and "an" are used herein to refer to one or to more than one (i.e. to at least one) of the grammatical object of the article. By way of example, "an element" means one element or more than one element.

The terms "tumor" or "cancer" refer to the presence of cells possessing characteristics typical of cancer-causing cells, such as uncontrolled proliferation, immortality, metastatic potential, rapid growth and proliferation rate, and certain characteristic morphological features. Cancer cells are often in the form of a tumor, but such cells may exist alone within an animal, or may be a non-tumorigenic cancer cell, such as a leukemia cell. As used herein, the term "cancer" includes premalignant as well as malignant cancers. Cancers include, but are not limited to, pancreatic cancer, e.g., pancreatic adenocarcinoma, melanomas, breast cancer, lung cancer, bronchus cancer, colorectal cancer, prostate cancer, pancreas cancer, stomach cancer, ovarian cancer, urinary bladder cancer, brain or central nervous system cancer, peripheral nervous system cancer, esophageal cancer, cervical cancer, uterine or endometrial cancer, cancer of the oral cavity or pharynx, liver cancer, kidney cancer, testicular cancer, biliary tract cancer, small bowel or appendix cancer, salivary gland cancer, thyroid gland cancer, adrenal gland cancer, osteosarcoma, chondrosarcoma, cancer of hematological tissues, and the like.

The term "pancreatic cancer" or "neoplasia" as used herein, includes PanIns, adenomas, adenocarcinomas, gastrinomas, somatostatinomas, insulinomas and glucagonomas of the pancreas.

As used herein, the term "adenocarcinoma" is carcinoma that develops in the lining or inner surface of an organ and is derived from glandular tissue or in which the tumor cells form recognizable glandular structures.

As used interchangeably herein, the terms, "pancreatic adenocarcinoma," or "pancreatic ductal adenocarcinoma" is an adenocarcinoma of the pancreas. In one embodiment, pancreatic adenocarcinomas arise from the progression of premalignant lesions that occur in the pancreatic ducts (pancreatic intraepithelial neoplasia, referred to herein as "PanIN"). The methods described herein may be used to detect premalignant cancers, e.g., PanIns, as well as malignant cancers.

A "minimal common region (MCR)," as used herein, refers to a contiguous chromosomal region which displays either gain and amplification (increased copy number) or loss and deletion (decreased copy number) in the genome of a cancer. An MCR includes at least one nucleic acid sequence which has increased or decreased copy number and which is associated with a cancer. The MCRs of the instant invention include, but are not limited to, those set forth in Table 1.

A "marker" is a gene or protein which may be altered, wherein said alteration is associated with cancer. The alteration may be in amount, structure, and/or activity in a cancer tissue or cancer cell, as compared to its amount, structure, and/or activity, in a normal or healthy tissue or cell (e.g., a control), and is associated with a disease state, such as cancer. For example, a marker of the invention which is associated with cancer may have altered copy number, expression level, protein level, protein activity, or methylation status, in a cancer tissue or cancer cell as compared to a normal, healthy tissue or cell. Furthermore, a "marker" includes a molecule whose structure is altered, e.g., mutated (contains an allelic variant), e.g., differs from the wild type sequence at the nucleotide or amino acid level, e.g., by substitution, deletion, or addition, when present in a tissue or cell associated with a disease state, such as cancer.

The term "altered amount" of a marker or "altered level" of a marker refers to increased or decreased copy number of a marker or chromosomal region, e.g., MCR, and/or increased or decreased expression level of a particular marker gene or genes in a cancer sample, as compared to the expression level or copy number of the marker in a control sample. The term "altered amount" of a marker also includes an increased or decreased protein level of a marker in a sample, e.g., a cancer sample, as compared to the protein level of the marker in a normal, control sample. Furthermore, an altered amount of a marker may be determined by detecting the methylation status of a marker, as described herein, which may affect the expression or activity of a marker.

The amount of a marker, e.g., expression or copy number of a marker or MCR, or protein level of a marker, in a subject is "significantly" higher or lower than the normal amount of a marker or MCR, if the amount of the marker is greater or less, respectively, than the normal level by an amount greater than the standard error of the assay employed to assess amount, and preferably at least twice, and more preferably three, four, five, ten or more times that amount. Alternately, the amount of the marker or MCR in the subject can be considered "significantly" higher or lower than the normal amount if the amount is at least about two, and preferably at least about three, four, or five times, higher or lower, respectively, than the normal amount of the marker or MCR.

The "copy number of a gene" or the "copy number of a marker" refers to the number of DNA sequences in a cell encoding a particular gene product. Generally, for a given gene, a mammal has two copies of each gene. The copy number can be increased, however, by gene amplification or duplication, or reduced by deletion.

The "normal" copy number of a marker or MCR or "normal" level of expression of a marker is the level of expression, copy number of the marker, or copy number of the MCR, in a biological sample, e.g., a sample containing tissue, whole blood, serum, plasma, buccal scrape, saliva, cerebrospinal fluid, urine, stool, bile, pancreatic juice, and pancreatic tissue, from a subject, e.g. a human, not afflicted with cancer.

The term "altered level of expression" of a marker or MCR refers to an expression level or copy number of a marker in a test sample e.g., a sample derived from a patient suffering from cancer, that is greater or less than the standard error of the assay employed to assess expression or copy number, and is preferably at least twice, and more preferably three, four, five or ten or more times the expression level or copy number of the marker or MCR in a control sample (e.g., sample from a healthy subjects not having the associated disease) and preferably, the average expression level or copy number of the marker or MCR in several control samples. The altered level of expression is greater or less than the standard error of the assay employed to assess expression or copy number, and is preferably at least twice, and more preferably three, four, five or ten or more times the expression level or copy number of the marker or MCR in a control sample (e.g., sample from a healthy subjects not having the associated disease) and preferably, the average expression level or copy number of the marker or MCR in several control samples.

An "overexpression" or "significantly higher level of expression or copy number" of a marker or MCR refers to an expression level or copy number in a test sample that is greater than the standard error of the assay employed to assess expression or copy number, and is preferably at least twice, and more preferably three, four, five or ten or more times the expression level or copy number of the marker or MCR in a control sample (e.g., sample from a healthy subject not afflicted with cancer) and preferably, the average expression level or copy number of the marker or MCR in several control samples.

"Methylation status" of a marker refers to the methylation pattern, e.g., methylation of the promoter of the marker, and/or methylation levels of the marker. DNA methylation is a heritable, reversible and epigenetic change. Yet, DNA methylation has the potential to alter gene expression, which has developmental and genetic consequences. DNA methylation has been linked to cancer, as described in, for example, Laird, et al. (1994) *Human Molecular Genetics* 3:1487-1495 and Laird, P. (2003) *Nature* 3:253-266, the contents of which are incorporated herein by reference. For example, methylation of CpG oligonucleotides in the promoters of tumor suppressor genes can lead to their inactivation. In addition, alterations in the normal methylation process are associated with genomic instability (Lengauer et al. Proc. Natl. Acad. Sci. USA 94:2545-2550, 1997). Such abnormal epigenetic changes may be found in many types of cancer and can, therefore, serve as potential markers for oncogenic transformation.

Methods for determining methylation include restriction landmark genomic scanning (Kawai et al., Mol. Cell. Biol. 14:7421-7427, 1994), methylation-sensitive arbitrarily primed PCR (Gonzalgo et al., Cancer Res. 57:594-599, 1997); digestion of genomic DNA with methylation-sensitive restriction enzymes followed by Southern analysis of the regions of interest (digestion-Southern method); PCR-based process that involves digestion of genomic DNA with methylation-sensitive restriction enzymes prior to PCR amplification (Singer-Sam et al., Nucl. Acids Res. 18:687, 1990); genomic sequencing using bisulfite treatment (Frommer et al., Proc. Natl. Acad. Sci. USA 89:1827-1831, 1992); methylation-specific PCR (MSP) (Herman et al. Proc. Natl. Acad. Sci. USA 93:9821-9826, 1992); and restriction enzyme digestion of PCR products amplified from bisulfite-converted DNA (Sadri and Hornsby, Nucl. Acids Res. 24:5058-5059, 1996; and Xiong and Laird, Nucl. Acids. Res. 25:2532-2534, 1997); PCR techniques for detection of gene mutations (Kuppuswamy et al., Proc. Natl. Acad. Sci. USA 88:1143-1147, 1991) and quantitation of allelic-specific expression (Szabo and Mann, Genes Dev. 9:3097-3108, 1995; and Singer-Sam et al., PCR Methods Appl. 1:160-163, 1992); and methods described in U.S. Pat. No. 6,251,594, the contents of which are incorporated herein by reference. An integrated genomic and epigenomic analysis as described in Zardo, et al. (2000) *Nature Genetics* 32:453-458, may also be used.

The term "altered activity" of a marker refers to an activity of a marker which is increased or decreased in a disease state, e.g., in a cancer sample, as compared to the activity of the marker in a normal, control sample. Altered activity of a marker may be the result of, for example, altered expression of the marker, altered protein level of the marker, altered structure of the marker, or, e.g., an altered interaction with other proteins involved in the same or different pathway as the marker or altered interaction with transcriptional activators or inhibitors, or altered methylation status.

The term "altered structure" of a marker refers to the presence of mutations or allelic variants within the marker gene or maker protein, e.g., mutations which affect expression or activity of the marker, as compared to the normal or wild-type gene or protein. For example, mutations include, but are not limited to substitutions, deletions, or addition mutations. Mutations may be present in the coding or non-coding region of the marker.

A "marker nucleic acid" is a nucleic acid (e.g., DNA, mRNA, cDNA) encoded by or corresponding to a marker of the invention. For example, such marker nucleic acid molecules include DNA (e.g., cDNA) comprising the entire or a partial sequence of any of the nucleic acid sequences set forth in Tables 4 or 5 or the complement or hybridizing fragment of such a sequence. The marker nucleic acid molecules also include RNA comprising the entire or a partial sequence of any of the nucleic acid sequences set forth in Tables 4 or 5 or the complement of such a sequence, wherein all thymidine residues are replaced with uridine residues. A "marker protein" is a protein encoded by or corresponding to a marker of the invention. A marker protein comprises the entire or a partial sequence of a protein encoded by any of the sequences set forth in Tables 4 or 5 or a fragment thereof. The terms "protein" and "polypeptide" are used interchangeably herein.

A "marker," as used herein, includes any nucleic acid sequence present in an MCR as set forth in Table 1, or a protein encoded by such a sequence.

Markers identified herein include diagnostic and therapeutic markers. A single marker may be a diagnostic marker, a therapeutic marker, or both a diagnostic and therapeutic marker.

As used herein, the term "therapeutic marker" includes markers, e.g., markers set forth in Tables 4 and 5, which are believed to be involved in the development (including maintenance, progression, angiogenesis, and/or metastasis) of cancer. The cancer-related functions of a therapeutic marker may be confirmed by, e.g., (1) increased or decreased copy number (by, e.g., fluorescence in situ hybridization (FISH) or quantitative PCR (qPCR)) or mutation (e.g., by sequencing), overexpression or underexpression (e.g., by in situ hybridization (ISH), Northern Blot, or qPCR), increased or decreased protein levels (e.g., by immunohistochemistry (IHC)), or increased or decreased protein activity (determined by, for example, modulation of a pathway in which the marker is involved), e.g., in more than about 5%, 6%, 7%, 8%, 9%, 10%, 11%, 12%, 13%, 14%, 15%, 20%, 25%, or more of human cancers; (2) the inhibition of cancer cell proliferation and growth, e.g., in soft agar, by, e.g., RNA interference ("RNAi") of the marker; (3) the ability of the marker to enhance transformation of mouse embryo fibroblasts (MEFs) by oncogenes, e.g., Myc and RAS, or by RAS alone; (4) the ability of the marker to enhance or decrease the growth of tumor cell lines, e.g., in soft agar; (5) the ability of the marker to transform primary mouse cells in SCID explant; and/or; (6) the prevention of maintenance or formation of tumors, e.g., tumors arising de novo in an animal or tumors derived from human cancer cell lines, by inhibiting or activating the marker. In one embodiment, a therapeutic marker may be used as a diagnostic marker.

As used herein, the term "diagnostic marker" includes markers, e.g., markers set forth in Tables 4 and 5, which are useful in the diagnosis of cancer, e.g., over- or under-activity emergence, expression, growth, remission, recurrence or resistance of tumors before, during or after therapy. The predictive functions of the marker may be confirmed by, e.g., (1) increased or decreased copy number (e.g., by FISH or qPCR), overexpression or underexpression (e.g., by ISH, Northern Blot, or qPCR), increased or decreased protein level (e.g., by IHC), or increased or decreased activity (determined by, for example, modulation of a pathway in which the marker is involved), e.g., in more than about 5%, 6%, 7%, 8%, 9%, 10%, 11%, 12%, 13%, 14%, 15%, 20%, 25%, or more of human cancers; (2) its presence or absence in a biological sample, e.g., a sample containing tissue, whole blood, serum, plasma, buccal scrape, saliva, cerebrospinal fluid, urine, stool, bile, pancreatic juice, and pancreatic tissue from a subject, e.g. a human, afflicted with cancer; (3) its presence or absence in clinical subset of patients with cancer (e.g., those responding to a particular therapy or those developing resistance). Diagnostic markers also include "surrogate markers," e.g., markers which are indirect markers of disease progression.

The term "probe" refers to any molecule which is capable of selectively binding to a specifically intended target molecule, for example a marker of the invention. Probes can be either synthesized by one skilled in the art, or derived from appropriate biological preparations. For purposes of detection of the target molecule, probes may be specifically designed to be labeled, as described herein. Examples of molecules that can be utilized as probes include, but are not limited to, RNA, DNA, proteins, antibodies, and organic monomers.

As used herein, the term "promoter/regulatory sequence" means a nucleic acid sequence which is required for expression of a gene product operably linked to the promoter/regulatory sequence. In some instances, this sequence may be the core promoter sequence and in other instances, this sequence may also include an enhancer sequence and other regulatory elements which are required for expression of the gene product. The promoter/regulatory sequence may, for example, be one which expresses the gene product in a tissue-specific manner.

An "RNA interfering agent" as used herein, is defined as any agent which interferes with or inhibits expression of a target gene, e.g., a marker of the invention, by RNA interference (RNAi). Such RNA interfering agents include, but are not limited to, nucleic acid molecules including RNA molecules which are homologous to the target gene, e.g., a marker of the invention, or a fragment thereof, short interfering RNA (siRNA), and small molecules which interfere with or inhibit expression of a target gene by RNA interference (RNAi).

"RNA interference (RNAi)" is an evolutionarily conserved process whereby the expression or introduction of RNA of a sequence that is identical or highly similar to a target gene results in the sequence specific degradation or specific post-transcriptional gene silencing (PTGS) of messenger RNA (mRNA) transcribed from that targeted gene (see Coburn, G. and Cullen, B. (2002) *J of Virology* 76(18):9225), thereby inhibiting expression of the target gene. In one embodiment, the RNA is double stranded RNA (dsRNA). This process has been described in plants, invertebrates, and mammalian cells. In nature, RNAi is initiated by the dsRNA-specific endonuclease Dicer, which promotes processive cleavage of long dsRNA into double-stranded fragments termed siRNAs. siRNAs are incorporated into a protein complex that recognizes and cleaves target mRNAs. RNAi can also be initiated by introducing nucleic acid molecules, e.g., synthetic siRNAs or RNA interfering agents, to inhibit or silence the expression of target genes. As used herein, "inhibition of target gene expression" or "inhibition of marker gene expression" includes any decrease in expression or protein activity or level of the target gene (e.g., a marker gene of the invention) or protein encoded by the target gene, e.g., a marker protein of the invention. The decrease may be of at least 30%, 40%, 50%, 60%, 70%, 80%, 90%, 95% or 99% or more as compared to the expression of a target gene or the activity or level of the protein encoded by a target gene which has not been targeted by an RNA interfering agent.

"Short interfering RNA" (siRNA), also referred to herein as "small interfering RNA" is defined as an agent which functions to inhibit expression of a target gene, e.g., by RNAi. An siRNA may be chemically synthesized, may be produced by in vitro transcription, or may be produced within a host cell. In one embodiment, siRNA is a double stranded RNA (dsRNA) molecule of about 15 to about 40 nucleotides in length, preferably about 15 to about 28 nucleotides, more preferably about 19 to about 25 nucleotides in length, and more preferably about 19, 20, 21, or 22 nucleotides in length, and may contain a 3' and/or 5' overhang on each strand having a length of about 0, 1, 2, 3, 4, or 5 nucleotides. The length of the overhang is independent between the two strands, i.e., the length of the over hang on one strand is not dependent on the length of the overhang on the second strand. Preferably the siRNA is capable of promoting RNA interference through degradation or specific post-transcriptional gene silencing (PTGS) of the target messenger RNA (mRNA).

In another embodiment, an siRNA is a small hairpin (also called stem loop) RNA (shRNA). In one embodiment, these shRNAs are composed of a short (e.g., 19-25 nucleotide) antisense strand, followed by a 5-9 nucleotide loop, and the analogous sense strand. Alternatively, the sense strand may precede the nucleotide loop structure and the antisense strand may follow. These shRNAs may be contained in plasmids, retroviruses, and lentiviruses and expressed from, for example, the pol III U6 promoter, or another promoter (see, e.g., Stewart, et al. (2003) RNA April; 9(4):493-501 incorporated be reference herein).

RNA interfering agents, e.g., siRNA molecules, may be administered to a patient having or at risk for having cancer, to inhibit expression of a marker gene of the invention, e.g., a marker gene which is overexpressed in cancer (such as the markers listed in Table 5) and thereby treat, prevent, or inhibit cancer in the subject.

A "constitutive" promoter is a nucleotide sequence which, when operably linked with a polynucleotide which encodes or specifies a gene product, causes the gene product to be produced in a living human cell under most or all physiological conditions of the cell.

An "inducible" promoter is a nucleotide sequence which, when operably linked with a polynucleotide which encodes or specifies a gene product, causes the gene product to be produced in a living human cell substantially only when an inducer which corresponds to the promoter is present in the cell.

A "tissue-specific" promoter is a nucleotide sequence which, when operably linked with a polynucleotide which encodes or specifies a gene product, causes the gene product to be produced in a living human cell substantially only if the cell is a cell of the tissue type corresponding to the promoter.

A "transcribed polynucleotide" is a polynucleotide (e.g. an RNA, a cDNA, or an analog of one of an RNA or cDNA) which is complementary to or homologous with all or a portion of a mature RNA made by transcription of a marker of the invention and normal post-transcriptional processing (e.g. splicing), if any, of the transcript, and reverse transcription of the transcript.

"Complementary" refers to the broad concept of sequence complementarity between regions of two nucleic acid strands or between two regions of the same nucleic acid strand. It is known that an adenine residue of a first nucleic acid region is capable of forming specific hydrogen bonds ("base pairing") with a residue of a second nucleic acid region which is antiparallel to the first region if the residue is thymine or uracil. Similarly, it is known that a cytosine residue of a first nucleic acid strand is capable of base pairing with a residue of a second nucleic acid strand which is antiparallel to the first strand if the residue is guanine. A first region of a nucleic acid is complementary to a second region of the same or a different nucleic acid if, when the two regions are arranged in an antiparallel fashion, at least one nucleotide residue of the first region is capable of base pairing with a residue of the second region. Preferably, the first region comprises a first portion and the second region comprises a second portion, whereby, when the first and second portions are arranged in an antiparallel fashion, at least about 50%, and preferably at least about 75%, at least about 90%, or at least about 95% of the nucleotide residues of the first portion are capable of base pairing with nucleotide residues in the second portion. More preferably, all nucleotide residues of the first portion are capable of base pairing with nucleotide residues in the second portion.

The terms "homology" or "identity," as used interchangeably herein, refer to sequence similarity between two polynucleotide sequences or between two polypeptide sequences, with identity being a more strict comparison. The phrases "percent identity or homology" and "% identity or homology" refer to the percentage of sequence similarity found in a comparison of two or more polynucleotide sequences or two or more polypeptide sequences. "Sequence similarity" refers to the percent similarity in base pair sequence (as determined by any suitable method) between two or more polynucleotide sequences. Two or more sequences can be anywhere from 0-100% similar, or any integer value there between. Identity or similarity can be determined by comparing a position in each sequence that may be aligned for purposes of comparison. When a position in the compared sequence is occupied by the same nucleotide base or amino acid, then the molecules are identical at that position. A degree of similarity or identity between polynucleotide sequences is a function of the number of identical or matching nucleotides at positions shared by the polynucleotide sequences. A degree of identity of polypeptide sequences is a function of the number of identical amino acids at positions shared by the polypeptide sequences.

A degree of homology or similarity of polypeptide sequences is a function of the number of amino acids at positions shared by the polypeptide sequences. The term "substantial homology," as used herein, refers to homology of at least 50%, more preferably, 60%, 70%, 80%, 90%, 95% or more.

A marker is "fixed" to a substrate if it is covalently or non-covalently associated with the substrate such the substrate can be rinsed with a fluid (e.g. standard saline citrate, pH 7.4) without a substantial fraction of the marker dissociating from the substrate.

As used herein, a "naturally-occurring" nucleic acid molecule refers to an RNA or DNA molecule having a nucleotide sequence that occurs in nature (e.g. encodes a natural protein).

Cancer is "inhibited" if at least one symptom of the cancer is alleviated, terminated, slowed, or prevented. As used herein, cancer is also "inhibited" if recurrence or metastasis of the cancer is reduced, slowed, delayed, or prevented.

A kit is any manufacture (e.g. a package or container) comprising at least one reagent, e.g. a probe, for specifically detecting a marker of the invention, the manufacture being promoted, distributed, or sold as a unit for performing the methods of the present invention.

II. Uses of the Invention

The present invention is based, in part, on the identification of chromosomal regions (MCRs) which are structurally altered leading to a different copy number in cancer cells as compared to normal (i.e. non-cancerous) cells. Furthermore, the present invention is based, in part, on the identification of markers, e.g., markers which reside in the MCRs of the invention, which have an altered amount, structure, and/or activity in cancer cells as compared to normal (i.e., non-cancerous) cells. The markers of the invention correspond to DNA, cDNA, RNA, and polypeptide molecules which can be detected in one or both of normal and cancerous cells.

The amount, structure, and/or activity, e.g., the presence, absence, copy number, expression level, protein level, protein activity, presence of mutations, e.g., mutations which affect activity of the marker (e.g., substitution, deletion, or addition mutations), and/or methylation status, of one or more of these markers in a sample, e.g., a sample containing tissue, whole blood, serum, plasma, buccal scrape, saliva, cerebrospinal fluid, urine, stool, bile, pancreatic juice, and pancreatic tissue, is herein correlated with the cancerous state of the tissue. In addition, the presence, absence, and/or copy number of one or more of the MCRs of the invention in a sample is also correlated with the cancerous state of the tissue. The invention thus provides compositions, kits, and methods for assessing the cancerous state of cells (e.g. cells obtained from a non-human, cultured non-human cells, and in vivo cells) as well as methods for treatment, prevention, and/or inhibition of cancer using a modulator, e.g., an agonist or antagonist, of a marker of the invention.

The compositions, kits, and methods of the invention have the following uses, among others:

1) assessing whether a subject is afflicted with cancer;
2) assessing the stage of cancer in a human subject;
3) assessing the grade of cancer in a subject;
4) assessing the benign or malignant nature of cancer in a subject;
5) assessing the metastatic potential of cancer in a subject;
6) assessing the histological type of neoplasm associated with cancer in a subject;
7) making antibodies, antibody fragments or antibody derivatives that are useful for treating cancer and/or assessing whether a subject is afflicted with cancer;
8) assessing the presence of cancer cells;

9) assessing the efficacy of one or more test compounds for inhibiting cancer in a subject;
10) assessing the efficacy of a therapy for inhibiting cancer in a subject;
11) monitoring the progression of cancer in a subject;
12) selecting a composition or therapy for inhibiting cancer, e.g., in a subject;
13) treating a subject afflicted with cancer;
14) inhibiting cancer in a subject;
15) assessing the carcinogenic potential of a test compound; and
16) preventing the onset of cancer in a subject at risk for developing cancer.

The invention thus includes a method of assessing whether a subject is afflicted with cancer or is at risk for developing cancer. This method comprises comparing the amount, structure, and/or activity, e.g., the presence, absence, copy number, expression level, protein level, protein activity, presence of mutations, e.g., mutations which affect activity of the marker (e.g., substitution, deletion, or addition mutations), and/or methylation status, of a marker in a subject sample with the normal level. A significant difference between the amount, structure, or activity of the marker in the subject sample and the normal level is an indication that the subject is afflicted with cancer. The invention also provides a method for assessing whether a subject is afflicted with cancer or is at risk for developing cancer by comparing the level of expression of marker(s) within an MCR or copy number of an MCR in a cancer sample with the level of expression of marker(s) within an MCR or copy number of an MCR in a normal, control sample. A significant difference between the level of expression of marker(s) within an MCR or copy number of the MCR in the subject sample and the normal level is an indication that the subject is afflicted with cancer. The MCR is selected from the group consisting of those listed in Table 1.

The marker is selected from the group consisting of the markers listed in Tables 4 and 5. Table 4 lists markers which have a highly significant correlation between gene expression and gene dosage (p, 0.05). The level of expression or copy number of these markers is decreased in samples histologically identified as pancreatic cancer, e.g., pancreatic adenocarcinoma. Table 4 also lists the chromosome, physical position in Mb, Gene Weight, p-value, Affymetrix™ probe(s) number corresponding to each UniGene ID, Genebank Accession No. (i.e., "GI" number), and SEQ ID NO. for each of the markers. Although one or more molecules corresponding to the markers listed in Table 4 may have been described by others, the significance of these markers with regard to the cancerous state of cells, has not previously been identified.

Table 5 also lists markers which have a highly significant correlation between gene expression and gene dosage (p, 0.05). The level of expression or copy number of these markers is increased in samples histologically identified as pancreatic cancer, e.g., pancreatic adenocarcinoma. Table 5 also lists the chromosome, physical position in Mb, Gene Weight, p-value, Affymetrix™ probe(s) number corresponding to each UniGene ID, Genebank Accession No. (i.e., "GI" number), and SEQ ID NO. for each of these markers. Although one or more molecules corresponding to the markers listed in Table 5 may have been described by others, the significance of these markers with regard to the cancerous state of cells, has not previously been identified.

Any marker or combination of markers listed in Tables 4 or 5 or any MCR or combination of MCRs listed in Table 1, may be used in the compositions, kits, and methods of the present invention. In general, it is preferable to use markers for which the difference between the amount, e.g., level of expression or copy number, and/or activity of the marker or MCR in cancer cells and the amount, e.g., level of expression or copy number, and/or activity of the same marker in normal cells, is as great as possible. Although this difference can be as small as the limit of detection of the method for assessing amount and/or activity of the marker, it is preferred that the difference be at least greater than the standard error of the assessment method, and preferably a difference of at least 2-, 3-, 4-, 5-, 6-, 7-, 8-, 9-, 10-, 15-, 20-, 25-, 100-, 500-, 1000-fold or greater than the amount, e.g., level of expression or copy number, and/or activity of the same biomarker in normal tissue.

It is understood that by routine screening of additional subject samples using one or more of the markers of the invention, it will be realized that certain of the markers have altered amount, structure, and/or activity in cancers of various types, including specific pancreatic cancers, as well as other cancers, e.g., carcinoma, sarcoma, lymphoma or leukemia, examples of which include, but are not limited to, melanomas, breast cancer, lung cancer, bronchus cancer, colorectal cancer, prostate cancer, pancreas cancer, stomach cancer, ovarian cancer, urinary bladder cancer, brain or central nervous system cancer, peripheral nervous system cancer, esophageal cancer, cervical cancer, uterine or endometrial cancer, cancer of the oral cavity or pharynx, liver cancer, kidney cancer, testicular cancer, biliary tract cancer, small bowel or appendix cancer, salivary gland cancer, thyroid gland cancer, adrenal gland cancer, osteosarcoma, chondrosarcoma, cancer of hematological tissues, and the like.

For example, it will be confirmed that some of the markers of the invention have altered amount, structure, and/or activity in some, i.e., 10%, 20%, 30%, or 40%, or most (i.e. 50% or more) or substantially all (i.e. 80% or more) of cancer, e.g., pancreatic cancer. Furthermore, it will be confirmed that certain of the markers of the invention are associated with cancer of various histologic subtypes.

In addition, as a greater number of subject samples are assessed for altered amount, structure, and/or activity of the markers or altered expression or copy number MCRs of the invention and the outcomes of the individual subjects from whom the samples were obtained are correlated, it will also be confirmed that markers have altered amount, structure, and/or activity of certain of the markers or altered expression or copy number of MCRs of the invention are strongly correlated with malignant cancers and that altered expression of other markers of the invention are strongly correlated with benign tumors or premalignant states. The compositions, kits, and methods of the invention are thus useful for characterizing one or more of the stage, grade, histological type, and benign/premalignant/malignant nature of cancer in subjects.

When the compositions, kits, and methods of the invention are used for characterizing one or more of the stage, grade, histological type, and benign/premalignant/malignant nature of cancer, in a subject, it is preferred that the marker or MCR or panel of markers or MCRs of the invention be selected such that a positive result is obtained in at least about 20%, and preferably at least about 40%, 60%, or 80%, and more preferably, in substantially all, subjects afflicted with cancer, of the corresponding stage, grade, histological type, or benign/premalignant/malignant nature. Preferably, the marker or panel of markers of the invention is selected such that a PPV (positive predictive value) of greater than about 10% is obtained for the general population (more preferably coupled with an assay specificity greater than 99.5%).

When a plurality of markers or MCRs of the invention are used in the compositions, kits, and methods of the invention, the amount, structure, and/or activity of each marker or level of expression or copy number can be compared with the normal amount, structure, and/or activity of each of the plurality of markers or level of expression or copy number, in non-cancerous samples of the same type, either in a single reaction mixture (i.e. using reagents, such as different fluorescent probes, for each marker) or in individual reaction mixtures corresponding to one or more of the markers or MCRs.

In one embodiment, a significantly altered amount, structure, and/or activity of more than one of the plurality of markers, or significantly altered copy number of one or more of the MCRs in the sample, relative to the corresponding normal levels, is an indication that the subject is afflicted with cancer. For example, a significantly lower copy number in the sample of each of the plurality of markers or MCRs, relative to the corresponding normal levels or copy number, is an indication that the subject is afflicted with cancer. In yet another embodiment, a significantly enhanced copy number of one or more markers or MCRs and a significantly lower level of expression or copy number of one or more markers or MCRs in a sample relative to the corresponding normal levels, is an indication that the subject is afflicted with cancer. Also, for example, a significantly enhanced copy number in the sample of each of the plurality of markers or MCRs, relative to the corresponding normal copy number, is an indication that the subject is afflicted with cancer. In yet another embodiment, a significantly enhanced copy number of one or more markers or MCRs and a significantly lower copy number of one or more markers or MCRs in a sample relative to the corresponding normal levels, is an indication that the subject is afflicted with cancer.

When a plurality of markers or MCRs are used, it is preferred that 2, 3, 4, 5, 8, 10, 12, 15, 20, 30, or 50 or more individual markers or MCRs be used or identified, wherein fewer markers or MCRs are preferred.

Only a small number of markers are known to be associated with, for example, pancreatic cancer (e.g., AKT2, $p16^{INK4a}$, c-MYC, SMAD4, and TP53; Lynch, supra). These markers or other markers which are known to be associated with other types of cancer may be used together with one or more markers of the invention in, for example, a panel of markers. In addition, frequent gains have been mapped to 3q, 5p, 7p, 8q, 11q, 12p, 17q and 20q and losses to 3p, 4q, 6q, 8p, 9p, 10q, 12q, 13q, 17p, 18q and 21q and 22q in pancreatic cancer. In some instances, validated oncogenes and tumor suppressor genes residing within these loci have been identified, including MYC (8q24), $p16^{INK4A}$ (9p21), p53 (17p13), SMAD4 (18q21) and AKT2 (19q13). It is well known that certain types of genes, such as oncogenes, tumor suppressor genes, growth factor-like genes, protease-like genes, and protein kinase-like genes are often involved with development of cancers of various types. Thus, among the markers of the invention, use of those which correspond to proteins which resemble known proteins encoded by known oncogenes and tumor suppressor genes, and those which correspond to proteins which resemble growth factors, proteases, and protein kinases, are preferred.

It is recognized that the compositions, kits, and methods of the invention will be of particular utility to subjects having an enhanced risk of developing cancer, and their medical advisors. Subjects recognized as having an enhanced risk of developing cancer, include, for example, subjects having a familial history of cancer, subjects identified as having a mutant oncogene (i.e. at least one allele), and subjects of advancing age.

An alteration, e.g. copy number, amount, structure, and/or activity of a marker in normal (i.e. non-cancerous) human tissue can be assessed in a variety of ways. In one embodiment, the normal level of expression or copy number is assessed by assessing the level of expression and/or copy number of the marker or MCR in a portion of cells which appear to be non-cancerous and by comparing this normal level of expression or copy number with the level of expression or copy number in a portion of the cells which are suspected of being cancerous. For example, when laparoscopy or other medical procedure, reveals the presence of a tumor on one portion of an organ, the normal level of expression or copy number of a marker or MCR may be assessed using the non-affected portion of the organ, and this normal level of expression or copy number may be compared with the level of expression or copy number of the same marker in an affected portion (i.e., the tumor) of the organ. Alternately, and particularly as further information becomes available as a result of routine performance of the methods described herein, population-average values for "normal" copy number, amount, structure, and/or activity of the markers or MCRs of the invention may be used. In other embodiments, the "normal" copy number, amount, structure, and/or activity of a marker or MCR may be determined by assessing copy number, amount, structure, and/or activity of the marker or MCR in a subject sample obtained from a non-cancer-afflicted subject, from a subject sample obtained from a subject before the suspected onset of cancer in the subject, from archived subject samples, and the like.

The invention includes compositions, kits, and methods for assessing the presence of cancer cells in a sample (e.g. an archived tissue sample or a sample obtained from a subject). These compositions, kits, and methods are substantially the same as those described above, except that, where necessary, the compositions, kits, and methods are adapted for use with certain types of samples. For example, when the sample is a parafinized, archived human tissue sample, it may be necessary to adjust the ratio of compounds in the compositions of the invention, in the kits of the invention, or the methods used. Such methods are well known in the art and within the skill of the ordinary artisan.

The invention thus includes a kit for assessing the presence of cancer cells (e.g. in a sample such as a subject sample). The kit may comprise one or more reagents capable of identifying a marker or MCR of the invention, e.g., binding specifically with a nucleic acid or polypeptide corresponding to a marker or MCR of the invention. Suitable reagents for binding with a polypeptide corresponding to a marker of the invention include antibodies, antibody derivatives, antibody fragments, and the like. Suitable reagents for binding with a nucleic acid (e.g. a genomic DNA, an mRNA, a spliced mRNA, a cDNA, or the like) include complementary nucleic acids. For example, the nucleic acid reagents may include oligonucleotides (labeled or non-labeled) fixed to a substrate, labeled oligonucleotides not bound with a substrate, pairs of PCR primers, molecular beacon probes, and the like.

The kit of the invention may optionally comprise additional components useful for performing the methods of the invention. By way of example, the kit may comprise fluids (e.g., SSC buffer) suitable for annealing complementary nucleic acids or for binding an antibody with a protein with which it specifically binds, one or more sample compartments, an instructional material which describes performance of a method of the invention, a sample of normal cells, a sample of cancer cells, and the like.

A kit of the invention may comprise a reagent useful for determining protein level or protein activity of a marker. In another embodiment, a kit of the invention may comprise a reagent for determining methylation status of a marker, or may comprise a reagent for determining alteration of structure of a marker, e.g., the presence of a mutation.

The invention also includes a method of making an isolated hybridoma which produces an antibody useful in methods and kits of the present invention. A protein corresponding to a marker of the invention may be isolated (e.g. by purification from a cell in which it is expressed or by transcription and translation of a nucleic acid encoding the protein in vivo or in vitro using known methods) and a vertebrate, preferably a mammal such as a mouse, rat, rabbit, or sheep, is immunized using the isolated protein. The vertebrate may optionally (and preferably) be immunized at least one additional time with the isolated protein, so that the vertebrate exhibits a robust immune response to the protein. Splenocytes are isolated from the immunized vertebrate and fused with an immortalized cell line to form hybridomas, using any of a variety of methods well known in the art. Hybridomas formed in this manner are then screened using standard methods to identify one or more hybridomas which produce an antibody which specifically binds with the protein. The invention also includes hybridomas made by this method and antibodies made using such hybridomas.

The invention also includes a method of assessing the efficacy of a test compound for inhibiting cancer cells. As described above, differences in the amount, structure, and/or activity of the markers of the invention, or level of expression or copy number of the MCRs of the invention, correlate with the cancerous state of cells. Although it is recognized that changes in the levels of amount, e.g., expression or copy number, structure, and/or activity of certain of the markers or expression or copy number of the MCRs of the invention likely result from the cancerous state of cells, it is likewise recognized that changes in the amount may induce, maintain, and promote the cancerous state. Thus, compounds which inhibit cancer, in a subject may cause a change, e.g., a change in expression and/or activity of one or more of the markers of the invention to a level nearer the normal level for that marker (e.g., the amount, e.g., expression, and/or activity for the marker in non-cancerous cells).

This method thus comprises comparing amount, e.g., expression, and/or activity of a marker in a first cell sample and maintained in the presence of the test compound and amount, e.g., expression, and/or activity of the marker in a second cell sample and maintained in the absence of the test compound. A significant increase in the amount, e.g., expression, and/or activity of a marker listed in Table 4 (e.g., a marker that was shown to be decreased in cancer), a significant decrease in the amount, e.g., expression, and/or activity of a marker listed in Table 5 (e.g., a marker that was shown to be increased in cancer), is an indication that the test compound inhibits cancer. The cell samples may, for example, be aliquots of a single sample of normal cells obtained from a subject, pooled samples of normal cells obtained from a subject, cells of a normal cell lines, aliquots of a single sample of cancer, cells obtained from a subject, pooled samples of cancer, cells obtained from a subject, cells of a cancer cell line, cells from an animal model of cancer, or the like. In one embodiment, the samples are cancer cells obtained from a subject and a plurality of compounds known to be effective for inhibiting various cancers, are tested in order to identify the compound which is likely to best inhibit the cancer in the subject.

This method may likewise be used to assess the efficacy of a therapy, e.g., chemotherapy, radiation therapy, surgery, or any other therapeutic approach useful for inhibiting cancer in a subject. In this method, the amount, e.g., expression, and/or activity of one or more markers of the invention in a pair of samples (one subjected to the therapy, the other not subjected to the therapy) is assessed. As with the method of assessing the efficacy of test compounds, if the therapy induces a significant decrease in the amount, e.g., expression, and/or activity of a marker listed in Table 5 (e.g., a marker that was shown to be increased in cancer), blocks induction of a marker listed in Table 5 (e.g., a marker that was shown to be increased in cancer), or if the therapy induces a significant enhancement of the amount, e.g., expression, and/or activity of a marker listed in Table 4 (e.g., a marker that was shown to be decreased in cancer), then the therapy is efficacious for inhibiting cancer. As above, if samples from a selected subject are used in this method, then alternative therapies can be assessed in vitro in order to select a therapy most likely to be efficacious for inhibiting cancer in the subject.

This method may likewise be used to monitor the progression of cancer in a subject, wherein if a sample in a subject has a significant decrease in the amount, e.g., expression, and/or activity of a marker listed in Table 5 (e.g., a marker that was shown to be increased in cancer, or blocks induction of a marker listed in Table 5 (e.g., a marker that was shown to be increased in cancer), or a significant enhancement of the amount, e.g., expression, and/or activity of a marker listed in Table 4 (e.g., a marker that was shown to be decreased in cancer), during the progression of cancer, e.g., at a first point in time and a subsequent point in time, then the cancer has improved. In yet another embodiment, between the first point in time and a subsequent point in time, the subject has undergone treatment, e.g., chemotherapy, radiation therapy, surgery, or any other therapeutic approach useful for inhibiting cancer, has completed treatment, or is in remission.

As described herein, cancer in subjects is associated with an increase in amount, e.g., expression, and/or activity of one or more markers listed in Table 5 (e.g., a marker that was shown to be increased in cancer), and/or a decrease in amount, e.g., expression, and/or activity of one or more markers listed in Table 4 (e.g., a marker that was shown to be decreased in cancer). While, as discussed above, some of these changes in amount, e.g., expression, and/or activity number result from occurrence of the cancer, others of these changes induce, maintain, and promote the cancerous state of cancer cells. Thus, cancer characterized by an increase in the amount, e.g., expression, and/or activity of one or more markers listed in Table 5 (e.g., a marker that was shown to be increased in cancer), can be inhibited by inhibiting amount, e.g., expression, and/or activity of those markers. Likewise, cancer characterized by a decrease in the amount, e.g., expression, and/or activity of one or more markers listed in Table 4 (e.g., a marker that was shown to be decreased in cancer), can be inhibited by enhancing amount, e.g., expression, and/or activity of those markers.

Amount and/or activity of a marker listed in Table 5 (e.g., a marker that was shown to be increased in cancer), can be inhibited in a number of ways generally known in the art. For example, an antisense oligonucleotide can be provided to the cancer cells in order to inhibit transcription, translation, or both, of the marker(s). An RNA interfering agent, e.g., an siRNA molecule, which is targeted to a marker listed in Table 5, can be provided to the cancer cells in order to inhibit expression of the target marker, e.g., through degradation or specific post-transcriptional gene silencing (PTGS) of the messenger RNA (mRNA) of the target marker. Alternately, a polynucleotide encoding an antibody, an antibody derivative, or an antibody fragment, e.g., a fragment capable of binding an antigen, and operably linked with an appropriate promoter or regulator region, can be provided to the cell in order to generate intracellular antibodies which will inhibit the function, amount, and/or activity of the protein corresponding to the marker(s). Conjugated antibodies or fragments thereof, e.g., chemolabeled antibodies, radiolabeled antibodies, or immunotoxins targeting a marker of the invention may also be administered to treat, prevent or inhibit cancer.

A small molecule may also be used to modulate, e.g., inhibit, expression and/or activity of a marker listed in Table 5. In one embodiment, a small molecule functions to disrupt a protein-protein interaction between a marker of the invention and a target molecule or ligand, thereby modulating, e.g., increasing or decreasing the activity of the marker.

Using the methods described herein, a variety of molecules, particularly including molecules sufficiently small that they are able to cross the cell membrane, can be screened in order to identify molecules which inhibit amount and/or activity of the marker(s). The compound so identified can be provided to the subject in order to inhibit amount and/or activity of the marker(s) in the cancer cells of the subject.

Amount and/or activity of a marker listed in Table 4 (e.g., a marker that was shown to be decreased in cancer), can be enhanced in a number of ways generally known in the art. For example, a polynucleotide encoding the marker and operably linked with an appropriate promoter/regulator region can be provided to cells of the subject in order to induce enhanced expression and/or activity of the protein (and mRNA) corresponding to the marker therein. Alternatively, if the protein is capable of crossing the cell membrane, inserting itself in the cell membrane, or is normally a secreted protein, then amount and/or activity of the protein can be enhanced by providing the protein (e.g. directly or by way of the bloodstream) to cancer cells in the subject. A small molecule may also be used to modulate, e.g., increase, expression or activity of a marker listed in Table 4. Furthermore, in another embodiment, a modulator of a marker of the invention, e.g., a small molecule, may be used, for example, to re-express a silenced gene, e.g., a tumor suppressor, in order to treat or prevent cancer. For example, such a modulator may interfere with a DNA binding element or a methyltransferase.

As described above, the cancerous state of human cells is correlated with changes in the amount and/or activity of the markers of the invention. Thus, compounds which induce increased expression or activity of one or more of the markers listed in Table 5 (e.g., a marker that was shown to be increased in cancer), decreased amount and/or activity of one or more of the markers listed in Table 4 (e.g., a marker that was shown to be decreased in cancer), can induce cell carcinogenesis. The invention also includes a method for assessing the human cell carcinogenic potential of a test compound. This method comprises maintaining separate aliquots of human cells in the presence and absence of the test compound. Expression or activity of a marker of the invention in each of the aliquots is compared. A significant increase in the amount and/or activity of a marker listed in Table 5 (e.g., a marker that was shown to be increased in cancer), or a significant decrease in the amount and/or activity of a marker listed in Table 4 (e.g., a marker that was shown to be decreased in cancer), in the aliquot maintained in the presence of the test compound (relative to the aliquot maintained in the absence of the test compound) is an indication that the test compound possesses human cell carcinogenic potential. The relative carcinogenic potentials of various test compounds can be assessed by comparing the degree of enhancement or inhibition of the amount and/or activity of the relevant markers, by comparing the number of markers for which the amount and/or activity is enhanced or inhibited, or by comparing both.

Various aspects of the invention are described in further detail in the following subsections.

III. Isolated Nucleic Acid Molecules

One aspect of the invention pertains to isolated nucleic acid molecules that correspond to a marker of the invention, including nucleic acids which encode a polypeptide corresponding to a marker of the invention or a portion of such a polypeptide. The nucleic acid molecules of the invention include those nucleic acid molecules which reside in the MCRs identified herein. Isolated nucleic acid molecules of the invention also include nucleic acid molecules sufficient for use as hybridization probes to identify nucleic acid molecules that correspond to a marker of the invention, including nucleic acid molecules which encode a polypeptide corresponding to a marker of the invention, and fragments of such nucleic acid molecules, e.g., those suitable for use as PCR primers for the amplification or mutation of nucleic acid molecules. As used herein, the term "nucleic acid molecule" is intended to include DNA molecules (e.g., cDNA or genomic DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" nucleic acid molecule is one which is separated from other nucleic acid molecules which are present in the natural source of the nucleic acid molecule. Preferably, an "isolated" nucleic acid molecule is free of sequences (preferably protein-encoding sequences) which naturally flank the nucleic acid (i.e., sequences located at the 5' and 3' ends of the nucleic acid) in the genomic DNA of the organism from which the nucleic acid is derived. For example, in various embodiments, the isolated nucleic acid molecule can contain less than about 5 kB, 4 kB, 3 kB, 2 kB, 1 kB, 0.5 kB or 0.1 kB of nucleotide sequences which naturally flank the nucleic acid molecule in genomic DNA of the cell from which the nucleic acid is derived. Moreover, an "isolated" nucleic acid molecule, such as a cDNA molecule, can be substantially free of other cellular material or culture medium when produced by recombinant techniques, or substantially free of chemical precursors or other chemicals when chemically synthesized.

A nucleic acid molecule of the present invention, e.g., a nucleic acid molecules encoding a protein corresponding to a marker listed in Tables 4 or 5, can be isolated using standard molecular biology techniques and the sequence information in the database records described herein. Using all or a portion of such nucleic acid sequences, nucleic acid molecules of the invention can be isolated using standard hybridization and cloning techniques (e.g., as described in Sambrook et al., ed., *Molecular Cloning: A Laboratory Manual, 2nd ed.*, Cold Spring Harbor Laboratory Press, Cold Spring Harbor, N.Y., 1989).

A nucleic acid molecule of the invention can be amplified using cDNA, mRNA, or genomic DNA as a template and appropriate oligonucleotide primers according to standard PCR amplification techniques. The nucleic acid molecules so amplified can be cloned into an appropriate vector and characterized by DNA sequence analysis. Furthermore, oligonucleotides corresponding to all or a portion of a nucleic acid molecule of the invention can be prepared by standard synthetic techniques, e.g., using an automated DNA synthesizer.

In another preferred embodiment, an isolated nucleic acid molecule of the invention comprises a nucleic acid molecule which has a nucleotide sequence complementary to the nucleotide sequence of a nucleic acid corresponding to a marker of the invention or to the nucleotide sequence of a nucleic acid encoding a protein which corresponds to a marker of the invention. A nucleic acid molecule which is complementary to a given nucleotide sequence is one which is sufficiently complementary to the given nucleotide sequence that it can hybridize to the given nucleotide sequence thereby forming a stable duplex.

Moreover, a nucleic acid molecule of the invention can comprise only a portion of a nucleic acid sequence, wherein the full length nucleic acid sequence comprises a marker of the invention or which encodes a polypeptide corresponding to a marker of the invention. Such nucleic acid molecules can be used, for example, as a probe or primer. The probe/primer typically is used as one or more substantially purified oligonucleotides. The oligonucleotide typically comprises a region of nucleotide sequence that hybridizes under stringent conditions to at least about 7, preferably about 15, more preferably about 25, 50, 75, 100, 125, 150, 175, 200, 250, 300, 350, or 400 or more consecutive nucleotides of a nucleic acid of the invention.

Probes based on the sequence of a nucleic acid molecule of the invention can be used to detect transcripts or genomic sequences corresponding to one or more markers of the invention. The probe comprises a label group attached thereto, e.g., a radioisotope, a fluorescent compound, an enzyme, or an enzyme co-factor. Such probes can be used as part of a diagnostic test kit for identifying cells or tissues which mis-express the protein, such as by measuring levels of a nucleic acid molecule encoding the protein in a sample of cells from a subject, e.g., detecting mRNA levels or determining whether a gene encoding the protein has been mutated or deleted.

The invention further encompasses nucleic acid molecules that differ, due to degeneracy of the genetic code, from the nucleotide sequence of nucleic acid molecules encoding a protein which corresponds to a marker of the invention, and thus encode the same protein.

In addition to the nucleotide sequences described in Tables 4 or 5, it will be appreciated by those skilled in the art that DNA sequence polymorphisms that lead to changes in the amino acid sequence can exist within a population (e.g., the human population). Such genetic polymorphisms can exist among individuals within a population due to natural allelic variation. An allele is one of a group of genes which occur alternatively at a given genetic locus. In addition, it will be appreciated that DNA polymorphisms that affect RNA expression levels can also exist that may affect the overall expression level of that gene (e.g., by affecting regulation or degradation).

As used herein, the phrase "allelic variant" refers to a nucleotide sequence which occurs at a given locus or to a polypeptide encoded by the nucleotide sequence.

As used herein, the terms "gene" and "recombinant gene" refer to nucleic acid molecules comprising an open reading frame encoding a polypeptide corresponding to a marker of the invention. Such natural allelic variations can typically result in 1-5% variance in the nucleotide sequence of a given gene. Alternative alleles can be identified by sequencing the gene of interest in a number of different individuals. This can be readily carried out by using hybridization probes to identify the same genetic locus in a variety of individuals. Any and all such nucleotide variations and resulting amino acid polymorphisms or variations that are the result of natural allelic variation and that do not alter the functional activity are intended to be within the scope of the invention.

In another embodiment, an isolated nucleic acid molecule of the invention is at least 7, 15, 20, 25, 30, 40, 60, 80, 100, 150, 200, 250, 300, 350, 400, 450, 550, 650, 700, 800, 900, 1000, 1200, 1400, 1600, 1800, 2000, 2200, 2400, 2600, 2800, 3000, 3500, 4000, 4500, or more nucleotides in length and hybridizes under stringent conditions to a nucleic acid molecule corresponding to a marker of the invention or to a nucleic acid molecule encoding a protein corresponding to a marker of the invention. As used herein, the term "hybridizes under stringent conditions" is intended to describe conditions for hybridization and washing under which nucleotide sequences at least 60% (65%, 70%, preferably 75%) identical to each other typically remain hybridized to each other. Such stringent conditions are known to those skilled in the art and can be found in sections 6.3.1-6.3.6 of Current Protocols in Molecular Biology, John Wiley & Sons, N.Y. (1989). A preferred, non-limiting example of stringent hybridization conditions are hybridization in 6× sodium chloride/sodium citrate (SSC) at about 45° C., followed by one or more washes in 0.2×SSC, 0.1% SDS at 50-65° C.

In addition to naturally-occurring allelic variants of a nucleic acid molecule of the invention that can exist in the population, the skilled artisan will further appreciate that sequence changes can be introduced by mutation thereby leading to changes in the amino acid sequence of the encoded protein, without altering the biological activity of the protein encoded thereby. For example, one can make nucleotide substitutions leading to amino acid substitutions at "non-essential" amino acid residues. A "non-essential" amino acid residue is a residue that can be altered from the wild-type sequence without altering the biological activity, whereas an "essential" amino acid residue is required for biological activity. For example, amino acid residues that are not conserved or only semi-conserved among homologs of various species may be non-essential for activity and thus would be likely targets for alteration. Alternatively, amino acid residues that are conserved among the homologs of various species (e.g., murine and human) may be essential for activity and thus would not be likely targets for alteration.

Accordingly, another aspect of the invention pertains to nucleic acid molecules encoding a polypeptide of the invention that contain changes in amino acid residues that are not essential for activity. Such polypeptides differ in amino acid sequence from the naturally-occurring proteins which correspond to the markers of the invention, yet retain biological activity. In one embodiment, such a protein has an amino acid sequence that is at least about 40% identical, 50%, 60%, 70%, 80%, 90%, 95%, or 98% identical to the amino acid sequence of one of the proteins which correspond to the markers of the invention.

An isolated nucleic acid molecule encoding a variant protein can be created by introducing one or more nucleotide substitutions, additions or deletions into the nucleotide sequence of nucleic acids of the invention, such that one or more amino acid residue substitutions, additions, or deletions are introduced into the encoded protein. Mutations can be introduced by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), non-polar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Alternatively, mutations can be introduced randomly along all or part of the coding sequence, such as by saturation mutagenesis, and the resultant mutants can be screened for biological activity to identify mutants that retain activity. Following mutagenesis, the encoded protein can be expressed recombinantly and the activity of the protein can be determined.

The present invention encompasses antisense nucleic acid molecules, i.e., molecules which are complementary to a sense nucleic acid of the invention, e.g., complementary to the coding strand of a double-stranded cDNA molecule corresponding to a marker of the invention or complementary to an mRNA sequence corresponding to a marker of the invention. Accordingly, an antisense nucleic acid molecule of the invention can hydrogen bond to (i.e. anneal with) a sense nucleic acid of the invention. The antisense nucleic acid can be complementary to an entire coding strand, or to only a portion thereof, e.g., all or part of the protein coding region (or open reading frame). An antisense nucleic acid molecule can also be antisense to all or part of a non-coding region of the coding strand of a nucleotide sequence encoding a polypeptide of the invention. The non-coding regions ("5' and 3' untranslated regions") are the 5' and 3' sequences which flank the coding region and are not translated into amino acids.

An antisense oligonucleotide can be, for example, about 5, 10, 15, 20, 25, 30, 35, 40, 45, or 50 or more nucleotides in length. An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a subject or generated in situ such that they hybridize with or bind to cellular mRNA and/or genomic DNA encoding a polypeptide corresponding to a selected marker of the invention to thereby inhibit expression of the marker, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. Examples of a route of administration of antisense nucleic acid molecules of the invention includes direct injection at a tissue site or infusion of the antisense nucleic acid into an ovary-associated body fluid. Alternatively, antisense nucleic acid molecules can be modified to target selected cells and then administered systemically. For example, for systemic administration, antisense molecules can be modified such that they specifically bind to receptors or antigens expressed on a selected cell surface, e.g., by linking the antisense nucleic acid molecules to peptides or antibodies which bind to cell surface receptors or antigens. The antisense nucleic acid molecules can also be delivered to cells using the vectors described herein. To achieve sufficient intracellular concentrations of the antisense molecules, vector constructs in which the antisense nucleic acid molecule is placed under the control of a strong pol II or pol III promoter are preferred.

An antisense nucleic acid molecule of the invention can be an α-anomeric nucleic acid molecule. An α-anomeric nucleic acid molecule forms specific double-stranded hybrids with complementary RNA in which, contrary to the usual α-units, the strands run parallel to each other (Gaultier et al., 1987, *Nucleic Acids Res.* 15:6625-6641). The antisense nucleic acid molecule can also comprise a 2'-o-methylribonucleotide (Inoue et al., 1987, *Nucleic Acids Res.* 15:6131-6148) or a chimeric RNA-DNA analogue (Inoue et al., 1987, *FEBS Lett.* 215:327-330).

The invention also encompasses ribozymes. Ribozymes are catalytic RNA molecules with ribonuclease activity which are capable of cleaving a single-stranded nucleic acid, such as an mRNA, to which they have a complementary region. Thus, ribozymes (e.g., hammerhead ribozymes as described in Haselhoff and Gerlach, 1988, *Nature* 334:585-591) can be used to catalytically cleave mRNA transcripts to thereby inhibit translation of the protein encoded by the mRNA. A ribozyme having specificity for a nucleic acid molecule encoding a polypeptide corresponding to a marker of the invention can be designed based upon the nucleotide sequence of a cDNA corresponding to the marker. For example, a derivative of a Tetrahymena L-19 IVS RNA can be constructed in which the nucleotide sequence of the active site is complementary to the nucleotide sequence to be cleaved (see Cech et al. U.S. Pat. No. 4,987,071; and Cech et al. U.S. Pat. No. 5,116,742). Alternatively, an mRNA encoding a polypeptide of the invention can be used to select a catalytic RNA having a specific ribonuclease activity from a pool of RNA molecules (see, e.g., Bartel and Szostak, 1993, *Science* 261:1411-1418).

The invention also encompasses nucleic acid molecules which form triple helical structures. For example, expression of a polypeptide of the invention can be inhibited by targeting nucleotide sequences complementary to the regulatory region of the gene encoding the polypeptide (e.g., the promoter and/or enhancer) to form triple helical structures that prevent transcription of the gene in target cells. See generally Helene (1991) *Anticancer Drug Des.* 6(6):569-84; Helene (1992) *Ann. N.Y. Acad. Sci.* 660:27-36; and Maher (1992) *Bioassays* 14(12):807-15.

In various embodiments, the nucleic acid molecules of the invention can be modified at the base moiety, sugar moiety or phosphate backbone to improve, e.g., the stability, hybridization, or solubility of the molecule. For example, the deoxyribose phosphate backbone of the nucleic acid molecules can be modified to generate peptide nucleic acid molecules (see Hyrup et al., 1996, *Bioorganic & Medicinal Chemistry* 4(1):

5-23). As used herein, the terms "peptide nucleic acids" or "PNAs" refer to nucleic acid mimics, e.g., DNA mimics, in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup et al. (1996), supra; Perry-O'Keefe et al. (1996) Proc. Natl. Acad. Sci. USA 93:14670-675.

PNAs can be used in therapeutic and diagnostic applications. For example, PNAs can be used as antisense or antigene agents for sequence-specific modulation of gene expression by, e.g., inducing transcription or translation arrest or inhibiting replication. PNAs can also be used, e.g., in the analysis of single base pair mutations in a gene by, e.g., PNA directed PCR clamping; as artificial restriction enzymes when used in combination with other enzymes, e.g., S1 nucleases (Hyrup (1996), supra; or as probes or primers for DNA sequence and hybridization (Hyrup, 1996, supra; Perry-O'Keefe et al., 1996, Proc. Natl. Acad. Sci. USA 93:14670-675).

In another embodiment, PNAs can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras can be generated which can combine the advantageous properties of PNA and DNA. Such chimeras allow DNA recognition enzymes, e.g., RNASE H and DNA polymerases, to interact with the DNA portion while the PNA portion would provide high binding affinity and specificity. PNA-DNA chimeras can be linked using linkers of appropriate lengths selected in terms of base stacking, number of bonds between the nucleobases, and orientation (Hyrup, 1996, supra). The synthesis of PNA-DNA chimeras can be performed as described in Hyrup (1996), supra, and Finn et al. (1996) Nucleic Acids Res. 24(17):3357-63. For example, a DNA chain can be synthesized on a solid support using standard phosphoramidite coupling chemistry and modified nucleoside analogs. Compounds such as 5'-(4-methoxytrityl) amino-5'-deoxy-thymidine phosphoramidite can be used as a link between the PNA and the 5' end of DNA (Mag et al., 1989, Nucleic Acids Res. 17:5973-88). PNA monomers are then coupled in a step-wise manner to produce a chimeric molecule with a 5' PNA segment and a 3' DNA segment (Finn et al., 1996, Nucleic Acids Res. 24(17):3357-63). Alternatively, chimeric molecules can be synthesized with a 5' DNA segment and a 3' PNA segment (Peterser et al., 1975, Bioorganic Med. Chem. Lett. 5:1119-11124).

In other embodiments, the oligonucleotide can include other appended groups such as peptides (e.g., for targeting host cell receptors in vivo), or agents facilitating transport across the cell membrane (see, e.g., Letsinger et al., 1989, Proc. Natl. Acad. Sci. USA 86:6553-6556; Lemaitre et al., 1987, Proc. Natl. Acad. Sci. USA 84:648-652; PCT Publication No. WO 88/09810) or the blood-brain barrier (see, e.g., PCT Publication No. WO 89/10134). In addition, oligonucleotides can be modified with hybridization-triggered cleavage agents (see, e.g., Krol et al., 1988, Bio/Techniques 6:958-976) or intercalating agents (see, e.g., Zon, 1988, Pharm. Res. 5:539-549). To this end, the oligonucleotide can be conjugated to another molecule, e.g., a peptide, hybridization triggered cross-linking agent, transport agent, hybridization-triggered cleavage agent, etc.

The invention also includes molecular beacon nucleic acid molecules having at least one region which is complementary to a nucleic acid molecule of the invention, such that the molecular beacon is useful for quantitating the presence of the nucleic acid molecule of the invention in a sample. A "molecular beacon" nucleic acid is a nucleic acid molecule comprising a pair of complementary regions and having a fluorophore and a fluorescent quencher associated therewith. The fluorophore and quencher are associated with different portions of the nucleic acid in such an orientation that when the complementary regions are annealed with one another, fluorescence of the fluorophore is quenched by the quencher. When the complementary regions of the nucleic acid molecules are not annealed with one another, fluorescence of the fluorophore is quenched to a lesser degree. Molecular beacon nucleic acid molecules are described, for example, in U.S. Pat. No. 5,876,930.

IV. Isolated Proteins and Antibodies

One aspect of the invention pertains to isolated proteins which correspond to individual markers of the invention, and biologically active portions thereof, as well as polypeptide fragments suitable for use as immunogens to raise antibodies directed against a polypeptide corresponding to a marker of the invention. In one embodiment, the native polypeptide corresponding to a marker can be isolated from cells or tissue sources by an appropriate purification scheme using standard protein purification techniques. In another embodiment, polypeptides corresponding to a marker of the invention are produced by recombinant DNA techniques. Alternative to recombinant expression, a polypeptide corresponding to a marker of the invention can be synthesized chemically using standard peptide synthesis techniques.

An "isolated" or "purified" protein or biologically active portion thereof is substantially free of cellular material or other contaminating proteins from the cell or tissue source from which the protein is derived, or substantially free of chemical precursors or other chemicals when chemically synthesized. The language "substantially free of cellular material" includes preparations of protein in which the protein is separated from cellular components of the cells from which it is isolated or recombinantly produced. Thus, protein that is substantially free of cellular material includes preparations of protein having less than about 30%, 20%, 10%, or 5% (by dry weight) of heterologous protein (also referred to herein as a "contaminating protein"). When the protein or biologically active portion thereof is recombinantly produced, it is also preferably substantially free of culture medium, i.e., culture medium represents less than about 20%, 10%, or 5% of the volume of the protein preparation. When the protein is produced by chemical synthesis, it is preferably substantially free of chemical precursors or other chemicals, i.e., it is separated from chemical precursors or other chemicals which are involved in the synthesis of the protein. Accordingly such preparations of the protein have less than about 30%, 20%, 10%, 5% (by dry weight) of chemical precursors or compounds other than the polypeptide of interest.

Biologically active portions of a polypeptide corresponding to a marker of the invention include polypeptides comprising amino acid sequences sufficiently identical to or derived from the amino acid sequence of the protein corresponding to the marker (e.g., the protein encoded by the nucleic acid molecules listed in Tables 4 or 5), which include fewer amino acids than the full length protein, and exhibit at least one activity of the corresponding full-length protein. Typically, biologically active portions comprise a domain or motif with at least one activity of the corresponding protein. A biologically active portion of a protein of the invention can be a polypeptide which is, for example, 10, 25, 50, 100 or more amino acids in length. Moreover, other biologically active portions, in which other regions of the protein are deleted, can be prepared by recombinant techniques and evaluated for one or more of the functional activities of the native form of a polypeptide of the invention.

Preferred polypeptides have an amino acid sequence of a protein encoded by a nucleic acid molecule listed in Tables 4 or 5. Other useful proteins are substantially identical (e.g., at least about 40%, preferably 50%, 60%, 70%, 80%, 90%, 95%, or 99%) to one of these sequences and retain the functional activity of the protein of the corresponding naturally-occurring protein yet differ in amino acid sequence due to natural allelic variation or mutagenesis.

To determine the percent identity of two amino acid sequences or of two nucleic acids, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences (i.e., % identity =#of identical positions/total # of positions (e.g., overlapping positions)×100). In one embodiment the two sequences are the same length.

The determination of percent identity between two sequences can be accomplished using a mathematical algorithm. A preferred, non-limiting example of a mathematical algorithm utilized for the comparison of two sequences is the algorithm of Karlin and Altschul (1990) *Proc. Natl. Acad. Sci. USA* 87:2264-2268, modified as in Karlin and Altschul (1993) *Proc. Natl. Acad. Sci. USA* 90:5873-5877. Such an algorithm is incorporated into the NBLAST and XBLAST programs of Altschul, et al. (1990) *J. Mol. Biol.* 215:403-410. BLAST nucleotide searches can be performed with the NBLAST program, score=100, wordlength=12 to obtain nucleotide sequences homologous to a nucleic acid molecules of the invention. BLAST protein searches can be performed with the XBLAST program, score=50, wordlength=3 to obtain amino acid sequences homologous to a protein molecules of the invention. To obtain gapped alignments for comparison purposes, Gapped BLAST can be utilized as described in Altschul et al. (1997) *Nucleic Acids Res.* 25:3389-3402. Alternatively, PSI-Blast can be used to perform an iterated search which detects distant relationships between molecules. When utilizing BLAST, Gapped BLAST, and PSI-Blast programs, the default parameters of the respective programs (e.g., XBLAST and NBLAST) can be used. See http://www.ncbi.nlm.nih.gov. Another preferred, non-limiting example of a mathematical algorithm utilized for the comparison of sequences is the algorithm of Myers and Miller, (1988) *Comput Appl Biosci,* 4:11-7. Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used. Yet another useful algorithm for identifying regions of local sequence similarity and alignment is the FASTA algorithm as described in Pearson and Lipman (1988) *Proc. Natl. Acad. Sci. USA* 85:2444-2448. When using the FASTA algorithm for comparing nucleotide or amino acid sequences, a PAM120 weight residue table can, for example, be used with a k-tuple value of 2.

The percent identity between two sequences can be determined using techniques similar to those described above, with or without allowing gaps. In calculating percent identity, only exact matches are counted.

The invention also provides chimeric or fusion proteins corresponding to a marker of the invention. As used herein, a "chimeric protein" or "fusion protein" comprises all or part (preferably a biologically active part) of a polypeptide corresponding to a marker of the invention operably linked to a heterologous polypeptide (i.e., a polypeptide other than the polypeptide corresponding to the marker). Within the fusion protein, the term "operably linked" is intended to indicate that the polypeptide of the invention and the heterologous polypeptide are fused in-frame to each other. The heterologous polypeptide can be fused to the amino-terminus or the carboxyl-terminus of the polypeptide of the invention.

One useful fusion protein is a GST fusion protein in which a polypeptide corresponding to a marker of the invention is fused to the carboxyl terminus of GST sequences. Such fusion proteins can facilitate the purification of a recombinant polypeptide of the invention.

In another embodiment, the fusion protein contains a heterologous signal sequence at its amino terminus. For example, the native signal sequence of a polypeptide corresponding to a marker of the invention can be removed and replaced with a signal sequence from another protein. For example, the gp67 secretory sequence of the baculovirus envelope protein can be used as a heterologous signal sequence (Ausubel et al., ed., *Current Protocols in Molecular Biology*, John Wiley & Sons, NY, 1992). Other examples of eukaryotic heterologous signal sequences include the secretory sequences of melittin and human placental alkaline phosphatase (Stratagene; La Jolla, Calif.). In yet another example, useful prokaryotic heterologous signal sequences include the phoA secretory signal (Sambrook et al., supra) and the protein A secretory signal (Pharmacia Biotech; Piscataway, N.J.).

In yet another embodiment, the fusion protein is an immunoglobulin fusion protein in which all or part of a polypeptide corresponding to a marker of the invention is fused to sequences derived from a member of the immunoglobulin protein family. The immunoglobulin fusion proteins of the invention can be incorporated into pharmaceutical compositions and administered to a subject to inhibit an interaction between a ligand (soluble or membrane-bound) and a protein on the surface of a cell (receptor), to thereby suppress signal transduction in vivo. The immunoglobulin fusion protein can be used to affect the bioavailability of a cognate ligand of a polypeptide of the invention. Inhibition of ligand/receptor interaction can be useful therapeutically, both for treating proliferative and differentiative disorders and for modulating (e.g. promoting or inhibiting) cell survival. Moreover, the immunoglobulin fusion proteins of the invention can be used as immunogens to produce antibodies directed against a polypeptide of the invention in a subject, to purify ligands and in screening assays to identify molecules which inhibit the interaction of receptors with ligands.

Chimeric and fusion proteins of the invention can be produced by standard recombinant DNA techniques. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see, e.g., Ausubel et al., supra). Moreover, many expression vectors are commercially available that already encode a fusion moiety (e.g., a GST polypeptide). A nucleic acid encoding a polypeptide of the invention can be cloned into such an expression vector such that the fusion moiety is linked in-frame to the polypeptide of the invention.

A signal sequence can be used to facilitate secretion and isolation of the secreted protein or other proteins of interest. Signal sequences are typically characterized by a core of hydrophobic amino acids which are generally cleaved from the mature protein during secretion in one or more cleavage events. Such signal peptides contain processing sites that allow cleavage of the signal sequence from the mature proteins as they pass through the secretory pathway. Thus, the invention pertains to the described polypeptides having a signal sequence, as well as to polypeptides from which the signal sequence has been proteolytically cleaved (i.e., the cleavage products). In one embodiment, a nucleic acid sequence encoding a signal sequence can be operably linked in an expression vector to a protein of interest, such as a protein which is ordinarily not secreted or is otherwise difficult to isolate. The signal sequence directs secretion of the protein, such as from a eukaryotic host into which the expression vector is transformed, and the signal sequence is subsequently or concurrently cleaved. The protein can then be readily purified from the extracellular medium by art recognized methods. Alternatively, the signal sequence can be linked to the protein of interest using a sequence which facilitates purification, such as with a GST domain.

The present invention also pertains to variants of the polypeptides corresponding to individual markers of the invention. Such variants have an altered amino acid sequence which can function as either agonists (mimetics) or as antagonists. Variants can be generated by mutagenesis, e.g., discrete point mutation or truncation. An agonist can retain substantially the same, or a subset, of the biological activities of the naturally occurring form of the protein. An antagonist of a protein can inhibit one or more of the activities of the naturally occurring form of the protein by, for example, competitively binding to a downstream or upstream member of a cellular signaling cascade which includes the protein of interest. Thus, specific biological effects can be elicited by treatment with a variant of limited function. Treatment of a subject with a variant having a subset of the biological activities of the naturally occurring form of the protein can have fewer side effects in a subject relative to treatment with the naturally occurring form of the protein.

Variants of a protein of the invention which function as either agonists (mimetics) or as antagonists can be identified by screening combinatorial libraries of mutants, e.g., truncation mutants, of the protein of the invention for agonist or antagonist activity. In one embodiment, a variegated library of variants is generated by combinatorial mutagenesis at the nucleic acid level and is encoded by a variegated gene library. A variegated library of variants can be produced by, for example, enzymatically ligating a mixture of synthetic oligonucleotides into gene sequences such that a degenerate set of potential protein sequences is expressible as individual polypeptides, or alternatively, as a set of larger fusion proteins (e.g., for phage display). There are a variety of methods which can be used to produce libraries of potential variants of the polypeptides of the invention from a degenerate oligonucleotide sequence. Methods for synthesizing degenerate oligonucleotides are known in the art (see, e.g., Narang, 1983, *Tetrahedron* 39:3; Itakura et al., 1984, *Annu. Rev. Biochem.* 53:323; Itakura et al., 1984, *Science* 198:1056; Ike et al., 1983 *Nucleic Acid Res.* 11:477).

In addition, libraries of fragments of the coding sequence of a polypeptide corresponding to a marker of the invention can be used to generate a variegated population of polypeptides for screening and subsequent selection of variants. For example, a library of coding sequence fragments can be generated by treating a double stranded PCR fragment of the coding sequence of interest with a nuclease under conditions wherein nicking occurs only about once per molecule, denaturing the double stranded DNA, renaturing the DNA to form double stranded DNA which can include sense/antisense pairs from different nicked products, removing single stranded portions from reformed duplexes by treatment with S1 nuclease, and ligating the resulting fragment library into an expression vector. By this method, an expression library can be derived which encodes amino terminal and internal fragments of various sizes of the protein of interest.

Several techniques are known in the art for screening gene products of combinatorial libraries made by point mutations or truncation, and for screening cDNA libraries for gene products having a selected property. The most widely used techniques, which are amenable to high throughput analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a technique which enhances the frequency of functional mutants in the libraries, can be used in combination with the screening assays to identify variants of a protein of the invention (Arkin and Yourvan, 1992, *Proc. Natl. Acad. Sci. USA* 89:7811-7815; Delgrave et al., 1993, *Protein Engineering* 6(3):327-331).

An isolated polypeptide corresponding to a marker of the invention, or a fragment thereof, can be used as an immunogen to generate antibodies using standard techniques for polyclonal and monoclonal antibody preparation. The full-length polypeptide or protein can be used or, alternatively, the invention provides antigenic peptide fragments for use as immunogens. The antigenic peptide of a protein of the invention comprises at least 8 (preferably 10, 15, 20, or 30 or more) amino acid residues of the amino acid sequence of one of the polypeptides of the invention, and encompasses an epitope of the protein such that an antibody raised against the peptide forms a specific immune complex with a marker of the invention to which the protein corresponds. Preferred epitopes encompassed by the antigenic peptide are regions that are located on the surface of the protein, e.g., hydrophilic regions. Hydrophobicity sequence analysis, hydrophilicity sequence analysis, or similar analyses can be used to identify hydrophilic regions.

An immunogen typically is used to prepare antibodies by immunizing a suitable (i.e. immunocompetent) subject such as a rabbit, goat, mouse, or other mammal or vertebrate. An appropriate immunogenic preparation can contain, for example, recombinantly-expressed or chemically-synthesized polypeptide. The preparation can further include an adjuvant, such as Freund's complete or incomplete adjuvant, or a similar immunostimulatory agent.

Accordingly, another aspect of the invention pertains to antibodies directed against a polypeptide of the invention. The terms "antibody" and "antibody substance" as used interchangeably herein refer to immunoglobulin molecules and immunologically active portions of immunoglobulin molecules, i.e., molecules that contain an antigen binding site which specifically binds an antigen, such as a polypeptide of the invention. A molecule which specifically binds to a given polypeptide of the invention is a molecule which binds the polypeptide, but does not substantially bind other molecules in a sample, e.g., a biological sample, which naturally contains the polypeptide. Examples of immunologically active portions of immunoglobulin molecules include F(ab) and F(ab')$_2$ fragments which can be generated by treating the antibody with an enzyme such as pepsin. The invention provides polyclonal and monoclonal antibodies. The term "monoclonal antibody" or "monoclonal antibody composition", as used herein, refers to a population of antibody molecules that contain only one species of an antigen binding site capable of immunoreacting with a particular epitope.

Polyclonal antibodies can be prepared as described above by immunizing a suitable subject with a polypeptide of the invention as an immunogen. The antibody titer in the immunized subject can be monitored over time by standard techniques, such as with an enzyme linked immunosorbent assay (ELISA) using immobilized polypeptide. If desired, the antibody molecules can be harvested or isolated from the subject (e.g., from the blood or serum of the subject) and further purified by well-known techniques, such as protein A chromatography to obtain the IgG fraction. At an appropriate time after immunization, e.g., when the specific antibody titers are highest, antibody-producing cells can be obtained from the subject and used to prepare monoclonal antibodies by standard techniques, such as the hybridoma technique originally described by Kohler and Milstein (1975) *Nature* 256:495-497, the human B cell hybridoma technique (see Kozbor et al., 1983, *Immunol. Today* 4:72), the EBV-hybridoma technique (see Cole et al., pp. 77-96 In *Monoclonal Antibodies and Cancer Therapy*, Alan R. Liss, Inc., 1985) or trioma techniques. The technology for producing hybridomas is well known (see generally *Current Protocols in Immunology*, Coligan et al. ed., John Wiley & Sons, New York, 1994). Hybridoma cells producing a monoclonal antibody of the invention are detected by screening the hybridoma culture supernatants for antibodies that bind the polypeptide of interest, e.g., using a standard ELISA assay.

Alternative to preparing monoclonal antibody-secreting hybridomas, a monoclonal antibody directed against a polypeptide of the invention can be identified and isolated by screening a recombinant combinatorial immunoglobulin library (e.g., an antibody phage display library) with the polypeptide of interest. Kits for generating and screening phage display libraries are commercially available (e.g., the Pharmacia *Recombinant Phage Antibody System*, Catalog No. 27-9400-01; and the Stratagene *SurfZAP Phage Display Kit*, Catalog No. 240612). Additionally, examples of methods and reagents particularly amenable for use in generating and screening antibody display library can be found in, for example, U.S. Pat. No. 5,223,409; PCT Publication No. WO 92/18619; PCT Publication No. WO 91/17271; PCT Publication No. WO 92/20791; PCT Publication No. WO 92/15679; PCT Publication No. WO 93/01288; PCT Publication No. WO 92/01047; PCT Publication No. WO 92/09690; PCT Publication No. WO 90/02809; Fuchs et al. (1991) *Bio/Technology* 9:1370-1372; Hay et al. (1992) *Hum. Antibod. Hybridomas* 3:81-85; Huse et al. (1989) *Science* 246:1275-1281; Griffiths et al. (1993) *EMBO J.* 12:725-734.

Additionally, recombinant antibodies, such as chimeric and humanized monoclonal antibodies, comprising both human and non-human portions, which can be made using standard recombinant DNA techniques, are within the scope of the invention. Such chimeric and humanized monoclonal antibodies can be produced by recombinant DNA techniques known in the art, for example using methods described in PCT Publication No. WO 87/02671; European Patent Application 184,187; European Patent Application 171,496; European Patent Application 173,494; PCT Publication No. WO 86/01533; U.S. Pat. No. 4,816,567; European Patent Application 125,023; Better et al. (1988) *Science* 240:1041-1043; Liu et al. (1987) *Proc. Natl. Acad. Sci. USA* 84:3439-3443; Liu et al. (1987) *J. Immunol.* 139:3521-3526; Sun et al. (1987) *Proc. Natl. Acad. Sci. USA* 84:214-218; Nishimura et al. (1987) *Cancer Res.* 47:999-1005; Wood et al. (1985) *Nature* 314:446-449; and Shaw et al. (1988) *J. Natl. Cancer Inst.* 80:1553-1559); Morrison (1985) *Science* 229:1202-1207; Oi et al. (1986) *Bio/Techniques* 4:214; U.S. Pat. No. 5,225,539; Jones et al. (1986) *Nature* 321:552-525; Verhoeyan et al. (1988) *Science* 239:1534; and Beidler et al. (1988) *J. Immunol.* 141:4053-4060.

Completely human antibodies are particularly desirable for therapeutic treatment of human subjects. Such antibodies can be produced using transgenic mice which are incapable of expressing endogenous immunoglobulin heavy and light chains genes, but which can express human heavy and light chain genes. The transgenic mice are immunized in the normal fashion with a selected antigen, e.g., all or a portion of a polypeptide corresponding to a marker of the invention. Monoclonal antibodies directed against the antigen can be obtained using conventional hybridoma technology. The human immunoglobulin transgenes harbored by the transgenic mice rearrange during B cell differentiation, and subsequently undergo class switching and somatic mutation. Thus, using such a technique, it is possible to produce therapeutically useful IgG, IgA and IgE antibodies. For an overview of this technology for producing human antibodies, see Lonberg and Huszar (1995) *Int. Rev. Immunol.* 13:65-93). For a detailed discussion of this technology for producing human antibodies and human monoclonal antibodies and protocols for producing such antibodies, see, e.g., U.S. Pat. Nos. 5,625,126; 5,633,425; 5,569,825; 5,661,016; and 5,545,806. In addition, companies such as Abgenix, Inc. (Freemont, Calif.), can be engaged to provide human antibodies directed against a selected antigen using technology similar to that described above.

Completely human antibodies which recognize a selected epitope can be generated using a technique referred to as "guided selection." In this approach a selected non-human monoclonal antibody, e.g., a murine antibody, is used to guide the selection of a completely human antibody recognizing the same epitope (Jespers et al., 1994, *Bio/technology* 12:899-903).

An antibody, antibody derivative, or fragment thereof, which specifically binds a marker of the invention which is overexpressed in cancer (e.g., a marker set forth in Table 5), may be used to inhibit activity of a marker, e.g., a marker set forth in Table 5, and therefore may be administered to a subject to treat, inhibit, or prevent cancer in the subject. Furthermore, conjugated antibodies may also be used to treat, inhibit, or prevent cancer in a subject. Conjugated antibodies, preferably monoclonal antibodies, or fragments thereof, are antibodies which are joined to drugs, toxins, or radioactive atoms, and used as delivery vehicles to deliver those substances directly to cancer cells. The antibody, e.g., an antibody which specifically binds a marker of the invention (e.g., a marker listed in Table 5), is administered to a subject and binds the marker, thereby delivering the toxic substance to the cancer cell, minimizing damage to normal cells in other parts of the body.

Conjugated antibodies are also referred to as "tagged," "labeled," or "loaded." Antibodies with chemotherapeutic agents attached are generally referred to as chemolabeled. Antibodies with radioactive particles attached are referred to as radiolabeled, and this type of therapy is known as radioimmunotherapy (RIT). Aside from being used to treat cancer, radiolabeled antibodies can also be used to detect areas of cancer spread in the body. Antibodies attached to toxins are called immunotoxins.

Immunotoxins are made by attaching toxins (e.g., poisonous substances from plants or bacteria) to monoclonal antibodies. Immunotoxins may be produced by attaching monoclonal antibodies to bacterial toxins such as diphtherial toxin (DT) or pseudomonal exotoxin (PE40), or to plant toxins such as ricin A or saporin.

An antibody directed against a polypeptide corresponding to a marker of the invention (e.g., a monoclonal antibody) can be used to isolate the polypeptide by standard techniques, such as affinity chromatography or immunoprecipitation. Moreover, such an antibody can be used to detect the marker (e.g., in a cellular lysate or cell supernatant) in order to evaluate the level and pattern of expression of the marker. The antibodies can also be used diagnostically to monitor protein levels in tissues or body fluids (e.g. in an ovary-associated body fluid) as part of a clinical testing procedure, e.g., to, for example, determine the efficacy of a given treatment regimen. Detection can be facilitated by coupling the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}I$, $^{131}I$, $^{35}S$ or $^3H$.

V. Recombinant Expression Vectors and Host Cells

Another aspect of the invention pertains to vectors, preferably expression vectors, containing a nucleic acid encoding a polypeptide corresponding to a marker of the invention (or a portion of such a polypeptide). As used herein, the term "vector" refers to a to nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors, namely expression vectors, are capable of directing the expression of genes to which they are operably linked. In general, expression vectors of utility in recombinant DNA techniques are often in the form of plasmids (vectors). However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell. This means that the recombinant expression vectors include one or more regulatory sequences, selected on the basis of the host cells to be used for expression, which is operably linked to the nucleic acid sequence to be expressed. Within a recombinant expression vector, "operably linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers and other expression control elements (e.g., polyadenylation signals). Such regulatory sequences are described, for example, in Goeddel, *Methods in Enzymology: Gene Expression Technology* vol. 185, Academic Press, San Diego, Calif. (1991). Regulatory sequences include those which direct constitutive expression of a nucleotide sequence in many types of host cell and those which direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, and the like. The expression vectors of the invention can be introduced into host cells to thereby produce proteins or peptides, including fusion proteins or peptides, encoded by nucleic acids as described herein.

The recombinant expression vectors of the invention can be designed for expression of a polypeptide corresponding to a marker of the invention in prokaryotic (e.g., *E. coli*) or eukaryotic cells (e.g., insect cells {using baculovirus expression vectors}, yeast cells or mammalian cells). Suitable host cells are discussed further in Goeddel, supra. Alternatively, the recombinant expression vector can be transcribed and translated in vitro, for example using T7 promoter regulatory sequences and T7 polymerase.

Expression of proteins in prokaryotes is most often carried out in *E. coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith and Johnson, 1988, *Gene* 67:31-40), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein.

Examples of suitable inducible non-fusion *E. coli* expression vectors include pTrc (Amann et al., 1988, *Gene* 69:301-315) and pET 11d (Studier et al., p. 60-89, In *Gene Expression Technology Methods in Enzymology* vol. 185, Academic Press, San Diego, Calif., 1991). Target gene expression from the pTrc vector relies on host RNA polymerase transcription from a hybrid trp-lac fusion promoter. Target gene expression from the pET 11d vector relies on transcription from a T7 gn10-lac fusion promoter mediated by a co-expressed viral RNA polymerase (T7 gn1). This viral polymerase is supplied by host strains BL21(DE3) or HMS174(DE3) from a resident prophage harboring a T7 gn1 gene under the transcriptional control of the lacUV 5 promoter.

One strategy to maximize recombinant protein expression in *E. coli* is to express the protein in a host bacteria with an impaired capacity to proteolytically cleave the recombinant protein (Gottesman, p. 119-128, *In Gene Expression Technology: Methods in Enzymology* vol. 185, Academic Press, San Diego, Calif., 1990. Another strategy is to alter the nucleic acid sequence of the nucleic acid to be inserted into an expression vector so that the individual codons for each amino acid are those preferentially utilized in *E. coli* (Wada et al., 1992, *Nucleic Acids Res.* 20:2111-2118). Such alteration of nucleic acid sequences of the invention can be carried out by standard DNA synthesis techniques.

In another embodiment, the expression vector is a yeast expression vector. Examples of vectors for expression in yeast *S. cerevisiae* include pYepSec1 (Baldari et al., 1987, *EMBO J.* 6:229-234), pMFa (Kurjan and Herskowitz, 1982, *Cell* 30:933-943), pJRY88 (Schultz et al., 1987, *Gene* 54:113-123), pYES2 (Invitrogen Corporation, San Diego, Calif.), and pPicZ (Invitrogen Corp, San Diego, Calif.).

Alternatively, the expression vector is a baculovirus expression vector. Baculovirus vectors available for expression of proteins in cultured insect cells (e.g., Sf 9 cells) include the pAc series (Smith et al., 1983, *Mol. Cell Biol.* 3:2156-2165) and the pVL series (Lucklow and Summers, 1989, *Virology* 170:31-39).

In yet another embodiment, a nucleic acid of the invention is expressed in mammalian cells using a mammalian expression vector. Examples of mammalian expression vectors include pCDM8 (Seed, 1987, *Nature* 329:840) and pMT2PC (Kaufman et al., 1987, *EMBO J.* 6:187-195). When used in mammalian cells, the expression vector's control functions are often provided by viral regulatory elements. For example, commonly used promoters are derived from polyoma, Adenovirus 2, cytomegalovirus and Simian Virus 40. For other suitable expression systems for both prokaryotic and eukaryotic cells see chapters 16 and 17 of Sambrook et al., supra.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert et al., 1987, *Genes Dev.* 1:268-277), lymphoid-specific promoters (Calame and Eaton, 1988, *Adv. Immunol.* 43:235-275), in particular promoters of T cell receptors (Winoto and Baltimore, 1989, *EMBO J.* 8:729-733) and immunoglobulins (Banerji et al., 1983, *Cell* 33:729-740; Queen and Baltimore, 1983, *Cell* 33:741-748), neuron-specific promoters (e.g., the neurofilament promoter; Byrne and Ruddle, 1989, *Proc. Natl. Acad. Sci. USA* 86:5473-5477), pancreas-specific promoters (Edlund et al., 1985, *Science* 230:912-916), and mammary gland-specific promoters (e.g., milk whey promoter; U.S. Pat. No. 4,873,316 and European Application Publication No. 264,166). Developmentally-regulated promoters are also encompassed, for example the murine hox promoters (Kessel and Gruss, 1990, *Science* 249:374-379) and the α-fetoprotein promoter (Camper and Tilghman, 1989, *Genes Dev.* 3:537-546).

The invention further provides a recombinant expression vector comprising a DNA molecule of the invention cloned into the expression vector in an antisense orientation: That is, the DNA molecule is operably linked to a regulatory sequence in a manner which allows for expression (by transcription of the DNA molecule) of an RNA molecule which is antisense to the mRNA encoding a polypeptide of the invention. Regulatory sequences operably linked to a nucleic acid cloned in the antisense orientation can be chosen which direct the continuous expression of the antisense RNA molecule in a variety of cell types, for instance viral promoters and/or enhancers, or regulatory sequences can be chosen which direct constitutive, tissue-specific or cell type specific expression of antisense RNA. The antisense expression vector can be in the form of a recombinant plasmid, phagemid, or attenuated virus in which antisense nucleic acids are produced under the control of a high efficiency regulatory region, the activity of which can be determined by the cell type into which the vector is introduced. For a discussion of the regulation of gene expression using antisense genes see Weintraub et al., 1986, *Trends in Genetics*, Vol. 1 (1).

Another aspect of the invention pertains to host cells into which a recombinant expression vector of the invention has been introduced. The terms "host cell" and "recombinant host cell" are used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic (e.g., *E. coli*) or eukaryotic cell (e.g., insect cells, yeast or mammalian cells).

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid into a host cell, including calcium phosphate or calcium chloride co-precipitation, DEAE-dextran-mediated transfection, lipofection, or electroporation. Suitable methods for transforming or transfecting host cells can be found in Sambrook, et al. (supra), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., for resistance to antibiotics) is generally introduced into the host cells along with the gene of interest. Preferred selectable markers include those which confer resistance to drugs, such as G418, hygromycin and methotrexate. Cells stably transfected with the introduced nucleic acid can be identified by drug selection (e.g., cells that have incorporated the selectable marker gene will survive, while the other cells die).

A host cell of the invention, such as a prokaryotic or eukaryotic host cell in culture, can be used to produce a polypeptide corresponding to a marker of the invention. Accordingly, the invention further provides methods for producing a polypeptide corresponding to a marker of the invention using the host cells of the invention. In one embodiment, the method comprises culturing the host cell of invention (into which a recombinant expression vector encoding a polypeptide of the invention has been introduced) in a suitable medium such that the marker is produced. In another embodiment, the method further comprises isolating the marker polypeptide from the medium or the host cell.

The host cells of the invention can also be used to produce nonhuman transgenic animals. For example, in one embodiment, a host cell of the invention is a fertilized oocyte or an embryonic stem cell into which sequences encoding a polypeptide corresponding to a marker of the invention have been introduced. Such host cells can then be used to create non-human transgenic animals in which exogenous sequences encoding a marker protein of the invention have been introduced into their genome or homologous recombinant animals in which endogenous gene(s) encoding a polypeptide corresponding to a marker of the invention sequences have been altered. Such animals are useful for studying the function and/or activity of the polypeptide corresponding to the marker, for identifying and/or evaluating modulators of polypeptide activity, as well as in pre-clinical testing of therapeutics or diagnostic molecules, for marker discovery or evaluation, e.g., therapeutic and diagnostic marker discovery or evaluation, or as surrogates of drug efficacy and specificity.

As used herein, a "transgenic animal" is a non-human animal, preferably a mammal, more preferably a rodent such as a rat or mouse, in which one or more of the cells of the animal includes a transgene. Other examples of transgenic animals include non-human primates, sheep, dogs, cows, goats, chickens, amphibians, etc. A transgene is exogenous DNA which is integrated into the genome of a cell from which a transgenic animal develops and which remains in the genome of the mature animal, thereby directing the expression of an encoded gene product in one or more cell types or tissues of the transgenic animal. As used herein, an "homologous recombinant animal" is a non-human animal, preferably a mammal, more preferably a mouse, in which an endogenous gene has been altered by homologous recombination between the endogenous gene and an exogenous DNA molecule introduced into a cell of the animal, e.g., an embryonic cell of the animal, prior to development of the animal. Transgenic animals also include inducible transgenic animals, such as those described in, for example, Chan I. T., et al. (2004) *J Clin Invest.* 113(4):528-38 and Chin L. et al (1999) *Nature* 400 (6743):468-72.

A transgenic animal of the invention can be created by introducing a nucleic acid encoding a polypeptide corresponding to a marker of the invention into the male pronuclei of a fertilized oocyte, e.g., by microinjection, retroviral infection, and allowing the oocyte to develop in a pseudopregnant female foster animal. Intronic sequences and polyadenylation signals can also be included in the transgene to increase the efficiency of expression of the transgene. A tissue-specific regulatory sequence(s) can be operably linked to the transgene to direct expression of the polypeptide of the invention to particular cells. Methods for generating transgenic animals via embryo manipulation and microinjection, particularly animals such as mice, have become conventional in the art and are described, for example, in U.S. Pat. Nos. 4,736,866 and 4,870,009, U.S. Pat. No. 4,873,191 and in Hogan, *Manipulating the Mouse Embryo*, Cold Spring Harbor Laboratory Press, Cold Spring Harbor, N.Y., 1986. Similar methods are used for production of other transgenic animals. A transgenic founder animal can be identified based upon the presence of the transgene in its genome and/or expression of mRNA encoding the transgene in tissues or cells of the animals. A transgenic founder animal can then be used to breed additional animals carrying the transgene. Moreover, transgenic animals carrying the transgene can further be bred to other transgenic animals carrying other transgenes.

To create an homologous recombinant animal, a vector is prepared which contains at least a portion of a gene encoding a polypeptide corresponding to a marker of the invention into which a deletion, addition or substitution has been introduced to thereby alter, e.g., functionally disrupt, the gene. In a preferred embodiment, the vector is designed such that, upon homologous recombination, the endogenous gene is functionally disrupted (i.e., no longer encodes a functional protein; also referred to as a "knock out" vector). Alternatively, the vector can be designed such that, upon homologous recombination, the endogenous gene is mutated or otherwise altered but still encodes functional protein (e.g., the upstream regulatory region can be altered to thereby alter the expression of the endogenous protein). In the homologous recombination vector, the altered portion of the gene is flanked at its 5' and 3' ends by additional nucleic acid of the gene to allow for homologous recombination to occur between the exogenous gene carried by the vector and an endogenous gene in an embryonic stem cell. The additional flanking nucleic acid sequences are of sufficient length for successful homologous recombination with the endogenous gene. Typically, several kilobases of flanking DNA (both at the 5' and 3' ends) are included in the vector (see, e.g., Thomas and Capecchi, 1987, *Cell* 51:503 for a description of homologous recombination vectors). The vector is introduced into an embryonic stem cell line (e.g., by electroporation) and cells in which the introduced gene has homologously recombined with the endogenous gene are selected (see, e.g., Li et al., 1992, *Cell* 69:915). The selected cells are then injected into a blastocyst of an animal (e.g., a mouse) to form aggregation chimeras (see, e.g., Bradley, *Teratocarcinomas and Embryonic Stem Cells: A Practical Approach*, Robertson, Ed., IRL, Oxford, 1987, pp. 113-152). A chimeric embryo can then be implanted into a suitable pseudopregnant female foster animal and the embryo brought to term. Progeny harboring the homologously recombined DNA in their germ cells can be used to breed animals in which all cells of the animal contain the homologously recombined DNA by germline transmission of the transgene. Methods for constructing homologous recombination vectors and homologous recombinant animals are described further in Bradley (1991) *Current Opinion in Bio/Technology* 2:823-829 and in PCT Publication NOS. WO 90/11354, WO 91/01140, WO 92/0968, and WO 93/04169.

In another embodiment, transgenic non-human animals can be produced which contain selected systems which allow for regulated expression of the transgene. One example of such a system is the cre/loxP recombinase system of bacteriophage P1. For a description of the cre/loxP recombinase system, see, e.g., Lakso et al. (1992) *Proc. Natl. Acad. Sci. USA* 89:6232-6236. Another example of a recombinase system is the FLP recombinase system of *Saccharomyces cerevisiae* (O'Gorman et al., 1991, *Science* 251:1351-1355). If a cre/loxP recombinase system is used to regulate expression of the transgene, animals containing transgenes encoding both the Cre recombinase and a selected protein are required. Such animals can be provided through the construction of "double" transgenic animals, e.g., by mating two transgenic animals, one containing a transgene encoding a selected protein and the other containing a transgene encoding a recombinase.

Clones of the non-human transgenic animals described herein can also be produced according to the methods described in Wilmut et al. (1997) *Nature* 385:810-813 and PCT Publication NOS. WO 97/07668 and WO 97/07669.

VI. Methods of Treatment

The present invention provides for both prophylactic and therapeutic methods of treating a subject, e.g., a human, who has or is at risk of (or susceptible to) cancer, e.g., pancreatic cancer. As used herein, "treatment" of a subject includes the application or administration of a therapeutic agent to a subject, or application or administration of a therapeutic agent to a cell or tissue from a subject, who has a diseases or disorder, has a symptom of a disease or disorder, or is at risk of (or susceptible to) a disease or disorder, with the purpose of curing, inhibiting, healing, alleviating, relieving, altering, remedying, ameliorating, improving, or affecting the disease or disorder, the symptom of the disease or disorder, or the risk of (or susceptibility to) the disease or disorder. As used herein, a "therapeutic agent" or "compound" includes, but is not limited to, small molecules, peptides, peptidomimetics, polypeptides, RNA interfering agents, e.g., siRNA molecules, antibodies, ribozymes, and antisense oligonucleotides.

As described herein, cancer in subjects is associated with a change, e.g., an increase in the amount and/or activity, or a change in the structure, of one or more markers listed in Table 5 (e.g., a marker that was shown to be increased in cancer), and/or a decrease in the amount and/or activity, or a change in the structure of one or more markers listed in Table 4 (e.g. a marker that was shown to be decreased in cancer). While, as discussed above, some of these changes in amount, structure, and/or activity, result from occurrence of the cancer, others of these changes induce, maintain, and promote the cancerous state of cancer, cells. Thus, cancer, characterized by an increase in the amount and/or activity, or a change in the structure, of one or more markers listed in Table 5 (e.g., a marker that is shown to be increased in cancer), can be inhibited by inhibiting amount, e.g., expression or protein level, and/or activity of those markers. Likewise, cancer characterized by a decrease in the amount and/or activity, or a change in the structure, of one or more markers listed in Table 4 (e.g., a marker that is shown to be decreased in cancer), can be inhibited by enhancing amount, e.g., expression or protein level, and/or activity of those markers.

Accordingly, another aspect of the invention pertains to methods for treating a subject suffering from cancer. These methods involve administering to a subject a compound which modulates amount and/or activity of one or more markers of the invention. For example, methods of treatment or prevention of cancer include administering to a subject a compound which decreases the amount and/or activity of one or more markers listed in Table 5 (e.g., a marker that was shown to be increased in cancer). Compounds, e.g., antagonists, which may be used to inhibit amount and/or activity of a marker listed in Table 5, to thereby treat or prevent cancer include antibodies (e.g., conjugated antibodies), small molecules, RNA interfering agents, e.g., siRNA molecules, ribozymes, and antisense oligonucleotides. In one embodiment, an antibody used for treatment is conjugated to a toxin, a chemotherapeutic agent, or radioactive particles.

Methods of treatment or prevention of cancer also include administering to a subject a compound which increases the amount and/or activity of one or more markers listed in Table 4 (e.g., a marker that was shown to be decreased in cancer). Compounds, e.g., agonists, which may be used to increase expression or activity of a marker listed in Table 4, to thereby treat or prevent cancer include small molecules, peptides, peptoids, peptidomimetics, and polypeptides.

Small molecules used in the methods of the invention include those which inhibit a protein-protein interaction and thereby either increase or decrease marker amount and/or activity. Furthermore, modulators, e.g., small molecules, which cause re-expression of silenced genes, e.g., tumor suppressors, are also included herein. For example, such molecules include compounds which interfere with DNA binding or methyltransferas activity.

An aptamer may also be used to modulate, e.g., increase or inhibit expression or activity of a marker of the invention to thereby treat, prevent or inhibit cancer. Aptamers are DNA or RNA molecules that have been selected from random pools based on their ability to bind other molecules. Aptamers may be selected which bind nucleic acids or proteins.

VII. Screening Assays

The invention also provides methods (also referred to herein as "screening assays") for identifying modulators, i.e., candidate or test compounds or agents (e.g., proteins, peptides, peptidomimetics, peptoids, small molecules or other drugs) which (a) bind to the marker, or (b) have a modulatory (e.g., stimulatory or inhibitory) effect on the activity of the marker or, more specifically, (c) have a modulatory effect on the interactions of the marker with one or more of its natural substrates (e.g., peptide, protein, hormone, co-factor, or nucleic acid), or (d) have a modulatory effect on the expression of the marker. Such assays typically comprise a reaction between the marker and one or more assay components. The other components may be either the test compound itself, or a combination of test compound and a natural binding partner of the marker. Compounds identified via assays such as those described herein may be useful, for example, for modulating, e.g., inhibiting, ameliorating, treating, or preventing cancer.

The test compounds of the present invention may be obtained from any available source, including systematic libraries of natural and/or synthetic compounds. Test compounds may also be obtained by any of the numerous approaches in combinatorial library methods known in the art, including: biological libraries; peptoid libraries (libraries of molecules having the functionalities of peptides, but with a novel, non-peptide backbone which are resistant to enzymatic degradation but which nevertheless remain bioactive; see, e.g., Zuckermann et al., 1994, *J. Med. Chem.* 37:2678-85); spatially addressable parallel solid phase or solution phase libraries; synthetic library methods requiring deconvolution; the 'one-bead one-compound' library method; and synthetic library methods using affinity chromatography selection. The biological library and peptoid library approaches are limited to peptide libraries, while the other four approaches are applicable to peptide, non-peptide oligomer or small molecule libraries of compounds (Lam, 1997, *Anticancer Drug Des.* 12:145).

Examples of methods for the synthesis of molecular libraries can be found in the art, for example in: DeWitt et al. (1993) *Proc. Natl. Acad. Sci. U.S.A.* 90:6909; Erb et al. (1994) *Proc. Natl. Acad. Sci. USA* 91:11422; Zuckermann et al. (1994). *J. Med. Chem.* 37:2678; Cho et al. (1993) *Science* 261:1303; Carrell et al. (1994) *Angew. Chem. Int. Ed. Engl.* 33:2059; Carrell et al. (1994) *Angew. Chem. Int. Ed. Engl.* 33:2061; and in Gallop et al. (1994)*J. Med. Chem.* 37:1233.

Libraries of compounds may be presented in solution (e.g., Houghten, 1992, *Biotechniques* 13:412-421), or on beads (Lam, 1991, *Nature* 354:82-84), chips (Fodor, 1993, *Nature* 364:555-556), bacteria and/or spores, (Ladner, U.S. Pat. No. 5,223,409), plasmids (Cull et al, 1992, *Proc Natl Acad Sci USA* 89:1865-1869) or on phage (Scott and Smith, 1990, *Science* 249:386-390; Devlin, 1990, *Science* 249:404-406; Cwirla-et al, 1990, *Proc. Natl. Acad. Sci.* 87:6378-6382; Felici, 1991, *J. Mol. Biol.* 222:301-310; Ladner, supra.).

In one embodiment, the invention provides assays for screening candidate or test compounds which are substrates of a marker or biologically active portion thereof. In another embodiment, the invention provides assays for screening candidate or test compounds which bind to a marker or biologically active portion thereof. Determining the ability of the test compound to directly bind to a marker can be accomplished, for example, by coupling the compound with a radioisotope or enzymatic label such that binding of the compound to the marker can be determined by detecting the labeled marker compound in a complex. For example, compounds (e.g., marker substrates) can be labeled with $^{125}I$, $^{35}S$, $^{14}C$, or $^{3}H$, either directly or indirectly, and the radioisotope detected by direct counting of radioemission or by scintillation counting. Alternatively, assay components can be enzymatically labeled with, for example, horseradish peroxidase, alkaline phosphatase, or luciferase, and the enzymatic label detected by determination of conversion of an appropriate substrate to product.

In another embodiment, the invention provides assays for screening candidate or test compounds which modulate the activity of a marker or a biologically active portion thereof. In all likelihood, the marker can, in vivo, interact with one or more molecules, such as, but not limited to, peptides, proteins, hormones, cofactors and nucleic acids. For the purposes of this discussion, such cellular and extracellular molecules are referred to herein as "binding partners" or marker "substrate".

One necessary embodiment of the invention in order to facilitate such screening is the use of the marker to identify its natural in vivo binding partners. There are many ways to accomplish this which are known to one skilled in the art. One example is the use of the marker protein as "bait protein" in a two-hybrid assay or three-hybrid assay (see, e.g., U.S. Pat. No. 5,283,317; Zervos et al, 1993, *Cell* 72:223-232; Madura et al, 1993, *J. Biol. Chem.* 268:12046-12054; Bartel et al, 1993, *Biotechniques* 14:920-924; Iwabuchi et al, 1993 *Oncogene* 8:1693-1696; Brent WO94/10300) in order to identify other proteins which bind to or interact with the marker (binding partners) and, therefore, are possibly involved in the natural function of the marker. Such marker binding partners are also likely to be involved in the propagation of signals by the marker or downstream elements of a marker-mediated signaling pathway. Alternatively, such marker binding partners may also be found to be inhibitors of the marker.

The two-hybrid system is based on the modular nature of most transcription factors, which consist of separable DNA-binding and activation domains. Briefly, the assay utilizes two different DNA constructs. In one construct, the gene that encodes a marker protein fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming a marker-dependent complex, the DNA-binding and activation domains of the transcription factor are brought into close proximity. This proximity allows transcription of a reporter gene (e.g., LacZ) which is operably linked to a transcriptional regulatory site responsive to the transcription factor. Expression of the reporter gene can be readily detected and cell colonies containing the functional transcription factor can be isolated and used to obtain the cloned gene which encodes the protein which interacts with the marker protein.

In a further embodiment, assays may be devised through the use of the invention for the purpose of identifying compounds which modulate (e.g., affect either positively or negatively) interactions between a marker and its substrates and/or binding partners. Such compounds can include, but are not limited to, molecules such as antibodies, peptides, hormones, oligonucleotides, nucleic acids, and analogs thereof. Such compounds may also be obtained from any available source, including systematic libraries of natural and/or synthetic compounds. The preferred assay components for use in this embodiment is a cancer, marker identified herein, the known binding partner and/or substrate of same, and the test compound. Test compounds can be supplied from any source.

The basic principle of the assay systems used to identify compounds that interfere with the interaction between the marker and its binding partner involves preparing a reaction mixture containing the marker and its binding partner under conditions and for a time sufficient to allow the two products to interact and bind, thus forming a complex. In order to test an agent for inhibitory activity, the reaction mixture is prepared in the presence and absence of the test compound. The test compound can be initially included in the reaction mixture, or can be added at a time subsequent to the addition of the marker and its binding partner. Control reaction mixtures are incubated without the test compound or with a placebo. The formation of any complexes between the marker and its binding partner is then detected. The formation of a complex in the control reaction, but less or no such formation in the reaction mixture containing the test compound, indicates that the compound interferes with the interaction of the marker and its binding partner. Conversely, the formation of more complex in the presence of compound than in the control reaction indicates that the compound may enhance interaction of the marker and its binding partner. The assay for compounds that interfere with the interaction of the marker with its binding partner may be conducted in a heterogeneous or homogeneous format. Heterogeneous assays involve anchoring either the marker or its binding partner onto a solid phase and detecting complexes anchored to the solid phase at the end of the reaction. In homogeneous assays, the entire reaction is carried out in a liquid phase. In either approach, the order of addition of reactants can be varied to obtain different information about the compounds being tested. For example, test compounds that interfere with the interaction between the markers and the binding partners (e.g., by competition) can be identified by conducting the reaction in the presence of the test substance, i.e., by adding the test substance to the reaction mixture prior to or simultaneously with the marker and its interactive binding partner. Alternatively, test compounds that disrupt preformed complexes, e.g. compounds with higher binding constants that displace one of the components from the complex, can be tested by adding the test compound to the reaction mixture after complexes have been formed. The various formats are briefly described below.

In a heterogeneous assay system, either the marker or its binding partner is anchored onto a solid surface or matrix, while the other corresponding non-anchored component may be labeled, either directly or indirectly. In practice, microtitre plates are often utilized for this approach. The anchored species can be immobilized by a number of methods, either non-covalent or covalent, that are typically well known to one who practices the art. Non-covalent attachment can often be accomplished simply by coating the solid surface with a solution of the marker or its binding partner and drying. Alternatively, an immobilized antibody specific for the assay component to be anchored can be used for this purpose. Such surfaces can often be prepared in advance and stored.

In related embodiments, a fusion protein can be provided which adds a domain that allows one or both of the assay components to be anchored to a matrix. For example, glutathione-S-transferase/marker fusion proteins or glutathione-S-transferase/binding partner can be adsorbed onto glutathione sepharose beads (Sigma Chemical, St. Louis, Mo.) or glutathione derivatized microtiter plates, which are then combined with the test compound or the test compound and either the non-adsorbed marker or its binding partner, and the mixture incubated under conditions conducive to complex formation (e.g., physiological conditions). Following incubation, the beads or microtiter plate wells are washed to remove any unbound assay components, the immobilized complex assessed either directly or indirectly, for example, as described above. Alternatively, the complexes can be dissociated from the matrix, and the level of marker binding or activity determined using standard techniques.

Other techniques for immobilizing proteins on matrices can also be used in the screening assays of the invention. For example, either a marker or a marker binding partner can be immobilized utilizing conjugation of biotin and streptavidin. Biotinylated marker protein or target molecules can be prepared from biotin-NHS(N-hydroxy-succinimide) using techniques known in the art (e.g., biotinylation kit, Pierce Chemicals, Rockford, Ill.), and immobilized in the wells of streptavidin-coated 96 well plates (Pierce Chemical). In certain embodiments, the protein-immobilized surfaces can be prepared in advance and stored.

In order to conduct the assay, the corresponding partner of the immobilized assay component is exposed to the coated surface with or without the test compound. After the reaction is complete, unreacted assay components are removed (e.g., by washing) and any complexes formed will remain immobilized on the solid surface. The detection of complexes anchored on the solid surface can be accomplished in a number of ways. Where the non-immobilized component is pre-labeled, the detection of label immobilized on the surface indicates that complexes were formed. Where the non-immobilized component is not pre-labeled, an indirect label can be used to detect complexes anchored on the surface; e.g., using a labeled antibody specific for the initially non-immobilized species (the antibody, in turn, can be directly labeled or indirectly labeled with, e.g., a labeled anti-Ig antibody). Depending upon the order of addition of reaction components, test compounds which modulate (inhibit or enhance) complex formation or which disrupt preformed complexes can be detected.

In an alternate embodiment of the invention, a homogeneous assay may be used. This is typically a reaction, analogous to those mentioned above, which is conducted in a liquid phase in the presence or absence of the test compound. The formed complexes are then separated from unreacted components, and the amount of complex formed is determined. As mentioned for heterogeneous assay systems, the order of addition of reactants to the liquid phase can yield information about which test compounds modulate (inhibit or enhance) complex formation and which disrupt preformed complexes.

In such a homogeneous assay, the reaction products may be separated from unreacted assay components by any of a number of standard techniques, including but not limited to: differential centrifugation, chromatography, electrophoresis and immunoprecipitation. In differential centrifugation, complexes of molecules may be separated from uncomplexed molecules through a series of centrifugal steps, due to the different sedimentation equilibria of complexes based on their different sizes and densities (see, for example, Rivas, G., and Minton, A. P., *Trends Biochem Sci* 1993 August; 18(8):284-7). Standard chromatographic techniques may also be utilized to separate complexed molecules from uncomplexed ones. For example, gel filtration chromatography separates molecules based on size, and through the utilization of an appropriate gel filtration resin in a column format, for example, the relatively larger complex may be separated from the relatively smaller uncomplexed components. Similarly, the relatively different charge properties of the complex as compared to the uncomplexed molecules may be exploited to differentially separate the complex from the remaining individual reactants, for example through the use of ion-exchange chromatography resins. Such resins and chromatographic techniques are well known to one skilled in the art (see, e.g., Heegaard, 1998, *J. Mol. Recognit.* 11:141-148; Hage and Tweed, 1997, *J. Chromatogr. B. Biomed. Sci. Appl.*, 699:499-525). Gel electrophoresis may also be employed to separate complexed molecules from unbound species (see, e.g., Ausubel et al (eds.), In: Current Protocols in Molecular Biology, J. Wiley & Sons, New York. 1999). In this technique, protein or nucleic acid complexes are separated based on size or charge, for example. In order to maintain the binding interaction during the electrophoretic process, nondenaturing gels in the absence of reducing agent are typically preferred, but conditions appropriate to the particular interactants will be well known to one skilled in the art. Immunoprecipitation is another common technique utilized for the isolation of a protein-protein complex from solution (see, e.g., Ausubel et al (eds.), In: Current Protocols in Molecular Biology, J. Wiley & Sons, New York. 1999). In this technique, all proteins binding to an antibody specific to one of the binding molecules are precipitated from solution by conjugating the antibody to a polymer bead that may be readily collected by centrifugation. The bound assay components are released from the beads (through a specific proteolysis event or other technique well known in the art which will not disturb the protein-protein interaction in the complex), and a second immunoprecipitation step is performed, this time utilizing antibodies specific for the correspondingly different interacting assay component. In this manner, only formed complexes should remain attached to the beads. Variations in complex formation in both the presence and the absence of a test compound can be compared, thus offering information about the ability of the compound to modulate interactions between the marker and its binding partner.

Also within the scope of the present invention are methods for direct detection of interactions between the marker and its natural binding partner and/or a test compound in a homogeneous or heterogeneous assay system without further sample manipulation. For example, the technique of fluorescence energy transfer may be utilized (see, e.g., Lakowicz et al, U.S. Pat. No. 5,631,169; Stavrianopoulos et al, U.S. Pat. No. 4,868,103). Generally, this technique involves the addition of a fluorophore label on a first 'donor' molecule (e.g., marker or test compound) such that its emitted fluorescent energy will be absorbed by a fluorescent label on a second, 'acceptor' molecule (e.g., marker or test compound), which in turn is able to fluoresce due to the absorbed energy. Alternately, the 'donor' protein molecule may simply utilize the natural fluorescent energy of tryptophan residues. Labels are chosen that emit different wavelengths of light, such that the 'acceptor' molecule label may be differentiated from that of the 'donor'. Since the efficiency of energy transfer between the labels is related to the distance separating the molecules, spatial relationships between the molecules can be assessed. In a situation in which binding occurs between the molecules, the fluorescent emission of the 'acceptor' molecule label in the assay should be maximal. An FET binding event can be conveniently measured through standard fluorometric detection means well known in the art (e.g., using a fluorimeter). A test substance which either enhances or hinders participation of one of the species in the preformed complex will result in the generation of a signal variant to that of background. In this way, test substances that modulate interactions between a marker and its binding partner can be identified in controlled assays.

In another embodiment, modulators of marker expression are identified in a method wherein a cell is contacted with a candidate compound and the expression of mRNA or protein, corresponding to a marker in the cell, is determined. The level of expression of mRNA or protein in the presence of the candidate compound is compared to the level of expression of mRNA or protein in the absence of the candidate compound.

The candidate compound can then be identified as a modulator of marker expression based on this comparison. For example, when expression of marker mRNA or protein is greater (statistically significantly greater) in the presence of the candidate compound than in its absence, the candidate compound is identified as a stimulator of marker mRNA or protein expression. Conversely, when expression of marker mRNA or protein is less (statistically significantly less) in the presence of the candidate compound than in its absence, the candidate compound is identified as an inhibitor of marker mRNA or protein expression. The level of marker mRNA or protein expression in the cells can be determined by methods described herein for detecting marker mRNA or protein.

In another aspect, the invention pertains to a combination of two or more of the assays described herein. For example, a modulating agent can be identified using a cell-based or a cell free assay, and the ability of the agent to modulate the activity of a marker protein can be further confirmed in vivo, e.g., in a whole animal model for cancer, cellular transformation and/or tumorigenesis. An animal model for pancreatic cancer is described in, for example, Aguirre A., et al. (2003) *Genes Dev.* December 15; 17(24):3112-26, the contents of which are expressly incorporated herein by reference. Additional animal based models of cancer are well known in the art (reviewed in Animal Models of Cancer Predisposition Syndromes, Hiai, H and Hino, O (eds.) 1999, *Progress in Experimental Tumor Research*, Vol. 35; Clarke A R *Carcinogenesis* (2000) 21:435-41) and include, for example, carcinogen-induced tumors (Rithidech, K et al. *Mutat Res* (1999) 428:33-39; Miller, M L et al. *Environ Mol Mutagen* (2000) 35:319-327), injection and/or transplantation of tumor cells into an animal, as well as animals bearing mutations in growth regulatory genes, for example, oncogenes (e.g., ras) (Arbeit, J M et al. *Am J Pathol* (1993) 142:1187-1197; Sinn, E et al. *Cell* (1987) 49:465-475; Thorgeirsson, S S et al. *Toxicol Lett* (2000) 112-113:553-555) and tumor suppressor genes (e.g., p53) (Vooijs, M et al. *Oncogene* (1999) 18:5293-5303; Clark A R *Cancer Metast Rev* (1995) 14:125-148; Kumar, T R et al. *J Intern Med* (1995) 238:233-238; Donehower, L A et al. (1992) Nature 356215-221). Furthermore, experimental model systems are available for the study of, for example, ovarian cancer (Hamilton, T C et al. *Semin Oncol* (1984) 11:285-298; Rahman, N A et al. *Mol Cell Endocrinol* (1998) 145:167-174; Beamer, W G et al. *Toxicol Pathol* (1998) 26:704-710), gastric cancer (Thompson, J et al. *Int J Cancer* (2000) 86:863-869; Fodde, R et al. *Cytogenet Cell Genet* (1999) 86:105-111), breast cancer (Li, M et al. *Oncogene* (2000) 19:1010-1019; Green, J E et al. *Oncogene* (2000) 19:1020-1027), melanoma (Satyamoorthy, K et al. *Cancer Metast Rev* (1999) 18:401-405), and prostate cancer (Shirai, T et al. *Mutat Res* (2000) 462:219-226; Bostwick, D G et al. *Prostate* (2000) 43:286-294). Animal models described in, for example, Chin L. et al (1999) *Nature* 400(6743):468-72, may also be used in the methods of the invention.

This invention further pertains to novel agents identified by the above-described screening assays. Accordingly, it is within the scope of this invention to further use an agent identified as described herein in an appropriate animal model. For example, an agent identified as described herein (e.g., a marker modulating agent, a small molecule, an antisense marker nucleic acid molecule, a ribozyme, a marker-specific antibody, or fragment thereof, a marker protein, a marker nucleic acid molecule, an RNA interfering agent, e.g., an siRNA molecule targeting a marker of the invention, or a marker-binding partner) can be used in an animal model to determine the efficacy, toxicity, or side effects of treatment with such an agent. Alternatively, an agent identified as described herein can be used in an animal model to determine the mechanism of action of such an agent. Furthermore, this invention pertains to uses of novel agents identified by the above-described screening assays for treatments as described herein.

VIII. Pharmaceutical Compositions

The small molecules, peptides, peptoids, peptidomimetics, polypeptides, RNA interfering agents, e.g., siRNA molecules, antibodies, ribozymes, and antisense oligonucleotides (also referred to herein as "active compounds" or "compounds") corresponding to a marker of the invention can be incorporated into pharmaceutical compositions suitable for administration. Such compositions typically comprise the small molecules, peptides, peptoids, peptidomimetics, polypeptides, RNA interfering agents, e.g., siRNA molecules, antibodies, ribozymes, or antisense oligonucleotides and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

The invention includes methods for preparing pharmaceutical compositions for modulating the expression or activity of a polypeptide or nucleic acid corresponding to a marker of the invention. Such methods comprise formulating a pharmaceutically acceptable carrier with an agent which modulates expression or activity of a polypeptide or nucleic acid corresponding to a marker of the invention. Such compositions can further include additional active agents. Thus, the invention further includes methods for preparing a pharmaceutical composition by formulating a pharmaceutically acceptable carrier with an agent which modulates expression or activity of a polypeptide or nucleic acid corresponding to a marker of the invention and one or more additional active compounds.

It is understood that appropriate doses of small molecule agents and protein or polypeptide agents depends upon a number of factors within the knowledge of the ordinarily skilled physician, veterinarian, or researcher. The dose(s) of these agents will vary, for example, depending upon the identity, size, and condition of the subject or sample being treated, further depending upon the route by which the composition is to be administered, if applicable, and the effect which the practitioner desires the agent to have upon the nucleic acid molecule or polypeptide of the invention. Small molecules include, but are not limited to, peptides, peptidomimetics, amino acids, amino acid analogs, polynucleotides, polynucleotide analogs, nucleotides, nucleotide analogs, organic or inorganic compounds (i.e., including heteroorganic and organometallic compounds) having a molecular weight less than about 10,000 grams per mole, organic or inorganic compounds having a molecular weight less than about 5,000 grams per mole, organic or inorganic compounds having a molecular weight less than about 1,000 grams per mole, organic or inorganic compounds having a molecular weight less than about 500 grams per mole, and salts, esters, and other pharmaceutically acceptable forms of such compounds.

Exemplary doses of a small molecule include milligram or microgram amounts per kilogram of subject or sample weight (e.g. about 1 microgram per kilogram to about 500 milligrams per kilogram, about 100 micrograms per kilogram to about 5 milligrams per kilogram, or about 1 microgram per kilogram to about 50 micrograms per kilogram).

As defined herein, a therapeutically effective amount of an RNA interfering agent, e.g., siRNA, (i.e., an effective dosage) ranges from about 0.001 to 3,000 mg/kg body weight, preferably about 0.01 to 2500 mg/kg body weight, more preferably about 0.1 to 2000, about 0.1 to 1000 mg/kg body weight, 0.1 to 500 mg/kg body weight, 0.1 to 100 mg/kg body weight, 0.1 to 50 mg/kg body weight, 0.1 to 25 mg/kg body weight, and even more preferably about 1 to 10 mg/kg, 2 to 9 mg/kg, 3 to 8 mg/kg, 4 to 7 mg/kg, or 5 to 6 mg/kg body weight. Treatment of a subject with a therapeutically effective amount of an RNA interfering agent can include a single treatment or, preferably, can include a series of treatments. In a preferred example, a subject is treated with an RNA interfering agent in the range of between about 0.1 to 20 mg/kg body weight, one time per week for between about 1 to 10 weeks, preferably between 2 to 8 weeks, more preferably between about 3 to 7 weeks, and even more preferably for about 4, 5, or 6 weeks.

Exemplary doses of a protein or polypeptide include gram, milligram or microgram amounts per kilogram of subject or sample weight (e.g. about 1 microgram per kilogram to about 5 grams per kilogram, about 100 micrograms per kilogram to about 500 milligrams per kilogram, or about 1 milligram per kilogram to about 50 milligrams per kilogram). It is furthermore understood that appropriate doses of one of these agents depend upon the potency of the agent with respect to the expression or activity to be modulated. Such appropriate doses can be determined using the assays described herein. When one or more of these agents is to be administered to an animal (e.g. a human) in order to modulate expression or activity of a polypeptide or nucleic acid of the invention, a physician, veterinarian, or researcher can, for example, prescribe a relatively low dose at first, subsequently increasing the dose until an appropriate response is obtained. In addition, it is understood that the specific dose level for any particular animal subject will depend upon a variety of factors including the activity of the specific agent employed, the age, body weight, general health, gender, and diet of the subject, the time of administration, the route of administration, the rate of excretion, any drug combination, and the degree of expression or activity to be modulated.

A pharmaceutical composition of the invention is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediamine-tetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersions. For intravenous administration, suitable carriers include physiological saline, bacteriostatic water, Cremophor EL (BASF; Parsippany, N.J.) or phosphate buffered saline (PBS). In all cases, the composition must be sterile and should be fluid to the extent that easy syringability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as mannitol, sorbitol, or sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound (e.g., a polypeptide or antibody) in the required amount in an appropriate solvent with one or a combination of ingredients enumerated above, as required, followed by filtered sterilization. Generally, dispersions are prepared by incorporating the active compound into a sterile vehicle which contains a basic dispersion medium, and then incorporating the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed.

Pharmaceutically compatible binding agents, and/or adjuvant materials can be included as part of the composition. The tablets, pills, capsules, troches, and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from a pressurized container or dispenser which contains a suitable propellant, e.g. a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes having monoclonal antibodies incorporated therein or thereon) can also be used as pharmaceutically acceptable carriers. These can be prepared according to methods known to those skilled in the art, for example, as described in U.S. Pat. No. 4,522,811.

It is especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the invention are dictated by and directly dependent on the unique characteristics of the active compound and the particular therapeutic effect to be achieved, and the limitations inherent in the art of compounding such an active compound for the treatment of individuals.

For antibodies, the preferred dosage is 0.1 mg/kg to 100 mg/kg of body weight (generally 10 mg/kg to 20 mg/kg). If the antibody is to act in the brain, a dosage of 50 mg/kg to 100 mg/kg is usually appropriate. Generally, partially human antibodies and fully human antibodies have a longer half-life within the human body than other antibodies. Accordingly, lower dosages and less frequent administration is often possible. Modifications such as lipidation can be used to stabilize antibodies and to enhance uptake and tissue penetration (e.g., into the epithelium). A method for lipidation of antibodies is described by Cruikshank et al. (1997) *J Acquired Immune Deficiency Syndromes and Human Retrovirology* 14:193.

The nucleic acid molecules corresponding to a marker of the invention can be inserted into vectors and used as gene therapy vectors. Gene therapy vectors can be delivered to a subject by, for example, intravenous injection, local administration (U.S. Pat. No. 5,328,470), or by stereotactic injection (see, e.g., Chen et al., 1994, *Proc. Natl. Acad. Sci. USA* 91:3054-3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g. retroviral vectors, the pharmaceutical preparation can include one or more cells which produce the gene delivery system.

The RNA interfering agents, e.g., siRNAs used in the methods of the invention can be inserted into vectors. These constructs can be delivered to a subject by, for example, intravenous injection, local administration (see U.S. Pat. No. 5,328, 470) or by stereotactic injection (see e.g., Chen et al. (1994) *Proc. Natl. Acad. Sci. USA* 91:3054-3057). The pharmaceutical preparation of the vector can include the RNA interfering agent, e.g., the siRNA vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

The pharmaceutical compositions can be included in a container, pack, or dispenser together with instructions for administration.

IX. Predictive Medicine

The present invention also pertains to the field of predictive medicine in which diagnostic assays, prognostic assays, pharmacogenomics, and monitoring clinical trails are used for prognostic (predictive) purposes to thereby treat an individual prophylactically. Accordingly, one aspect of the present invention relates to diagnostic assays for determining the amount, structure, and/or activity of polypeptides or nucleic acids corresponding to one or more markers of the invention, in order to determine whether an individual is at risk of developing cancer. Such assays can be used for prognostic or predictive purposes to thereby prophylactically treat an individual prior to the onset of the cancer.

Yet another aspect of the invention pertains to monitoring the influence of agents (e.g., drugs or other compounds administered either to inhibit cancer, or to treat or prevent any other disorder {i.e. in order to understand any carcinogenic effects that such treatment may have}) on the amount, structure, and/or activity of a marker of the invention in clinical trials. These and other agents are described in further detail in the following sections.

A. Diagnostic Assays

1. Methods for Detection of Copy Number

Methods of evaluating the copy number of a particular marker or chromosomal region (e.g., an MCR) are well known to those of skill in the art. The presence or absence of chromosomal gain or loss can be evaluated simply by a determination of copy number of the regions or markers identified herein.

Methods for evaluating copy number of encoding nucleic acid in a sample include, but are not limited to, hybridization-based assays. For example, one method for evaluating the copy number of encoding nucleic acid in a sample involves a Southern Blot. In a Southern Blot, the genomic DNA (typically fragmented and separated on an electrophoretic gel) is hybridized to a probe specific for the target region. Comparison of the intensity of the hybridization signal from the probe for the target region with control probe signal from analysis of normal genomic DNA (e.g., a non-amplified portion of the same or related cell, tissue, organ, etc.) provides an estimate of the relative copy number of the target nucleic acid.

An alternative means for determining the copy number is in situ hybridization (e.g., Angerer (1987) Meth. Enzymol 152: 649). Generally, in situ hybridization comprises the following steps: (1) fixation of tissue or biological structure to be analyzed; (2) prehybridization treatment of the biological structure to increase accessibility of target DNA, and to reduce nonspecific binding; (3) hybridization of the mixture of nucleic acids to the nucleic acid in the biological structure or tissue; (4) post-hybridization washes to remove nucleic acid fragments not bound in the hybridization and (5) detection of the hybridized nucleic acid fragments. The reagent used in each of these steps and the conditions for use vary depending on the particular application.

Preferred hybridization-based assays include, but are not limited to, traditional "direct probe" methods such as Southern blots or in situ hybridization (e.g., FISH), and "comparative probe" methods such as comparative genomic hybridization (CGH), e.g., cDNA-based or oligonucleotide-based CGH. The methods can be used in a wide variety of formats including, but not limited to, substrate (e.g. membrane or glass) bound methods or array-based approaches.

In a typical in situ hybridization assay, cells are fixed to a solid support, typically a glass slide. If a nucleic acid is to be probed, the cells are typically denatured with heat or alkali. The cells are then contacted with a hybridization solution at a moderate temperature to permit annealing of labeled probes specific to the nucleic acid sequence encoding the protein. The targets (e.g., cells) are then typically washed at a predetermined stringency or at an increasing stringency until an appropriate signal to noise ratio is obtained.

The probes are typically labeled, e.g., with radioisotopes or fluorescent reporters. Preferred probes are sufficiently long so as to specifically hybridize with the target nucleic acid(s) under stringent conditions. The preferred size range is from about 200 bases to about 1000 bases.

In some applications it is necessary to block the hybridization capacity of repetitive sequences. Thus, in some embodiments, tRNA, human genomic DNA, or Cot-I DNA is used to block non-specific hybridization.

In CGH methods, a first collection of nucleic acids (e.g. from a sample, e.g., a possible tumor) is labeled with a first label, while a second collection of nucleic acids (e.g. a control, e.g., from a healthy cell/tissue) is labeled with a second label. The ratio of hybridization of the nucleic acids is determined by the ratio of the two (first and second) labels binding to each fiber in the array. Where there are chromosomal deletions or multiplications, differences in the ratio of the signals from the two labels will be detected and the ratio will provide a measure of the copy number. Array-based CGH may also be performed with single-color labeling (as opposed to labeling the control and the possible tumor sample with two different dyes and mixing them prior to hybridization, which will yield ratio due to competitive hybridization to probes on the arrays). In single color CGH, the control is labeled and hybridized to one array and absolute signals are read, and the possible tumor sample is labeled and hybridized to a second array (with identical content) and absolute signals are read. Copy number difference is calculated based on absolute signals from the two arrays. Hybridization protocols suitable for use with the methods of the invention are described, e.g., in Albertson (1984) EMBO J. 3: 1227-1234; Pinkel (1988) Proc. Natl. Acad. Sci. USA 85: 9138-9142; EPO Pub. No. 430, 402; Methods in Molecular Biology, Vol. 33: In Situ Hybridization Protocols, Choo, ed., Humana Press, Totowa, N.J. (1994), etc. In one embodiment, the hybridization protocol of Pinkel et al. (1998) Nature Genetics 20: 207-211, or of Kallioniemi (1992) Proc. Natl Acad Sci USA 89:5321-5325 (1992) is used.

The methods of the invention are particularly well suited to array-based hybridization formats. Array-based CGH is described in U.S. Pat. No. 6,455,258, the contents of which are incorporated herein by reference.

In still another embodiment, amplification-based assays can be used to measure copy number. In such amplification-based assays, the nucleic acid sequences act as a template in an amplification reaction (e.g., Polymerase Chain Reaction (PCR). In a quantitative amplification, the amount of amplification product will be proportional to the amount of template in the original sample. Comparison to appropriate controls, e.g. healthy tissue, provides a measure of the copy number.

Methods of "quantitative" amplification are well known to those of skill in the art. For example, quantitative PCR involves simultaneously co-amplifying a known quantity of a control sequence using the same primers. This provides an internal standard that may be used to calibrate the PCR reaction. Detailed protocols for quantitative PCR are provided in Innis et al. (1990) PCR Protocols, A Guide to Methods and Applications, Academic Press, Inc. N.Y.). Measurement of DNA copy number at microsatellite loci using quantitative PCR analysis is described in Ginzonger, et al (2000) *Cancer Research* 60:5405-5409. The known nucleic acid sequence for the genes is sufficient to enable one of skill in the art to routinely select primers to amplify any portion of the gene. Fluorogenic quantitative PCR may also be used in the methods of the invention. In fluorogenic quantitative PCR, quantitation is based on amount of fluorescence signals, e.g., TaqMan and sybr green.

Other suitable amplification methods include, but are not limited to, ligase chain reaction (LCR) (see Wu and Wallace (1989) Genomics 4: 560, Landegren et al. (1988) Science 241: 1077, and Barringer et al. (1990) Gene 89: 117, transcription amplification (Kwoh et al. (1989) Proc. Natl. Acad. Sci. USA 86: 1173), self-sustained sequence replication (Guatelli et al. (1990) Proc. Nat. Acad. Sci. USA 87: 1874), dot PCR, and linker adapter PCR, etc.

Loss of heterozygosity (LOH) mapping (Wang Z. C. et al. (2004) *Cancer Res* 64(1):64-71; Seymour, A. B., et al. (1994) *Cancer Res* 54, 2761-4; Hahn, S. A., et al. (1995) *Cancer Res* 55, 4670-5; Kimura, M., et al. (1996) *Genes Chromosomes Cancer* 17, 88-93) may also be used to identify regions of amplification or deletion.

2. Methods for Detection of Gene Expression

Marker expression level can also be assayed as a method for diagnosis of cancer or risk for developing cancer. Expression of a marker of the invention may be assessed by any of a wide variety of well known methods for detecting expression of a transcribed molecule or protein. Non-limiting examples of such methods include immunological methods for detection of secreted, cell-surface, cytoplasmic, or nuclear proteins, protein purification methods, protein function or activity assays, nucleic acid hybridization methods, nucleic acid reverse transcription methods, and nucleic acid amplification methods.

In preferred embodiments, activity of a particular gene is characterized by a measure of gene transcript (e.g. mRNA), by a measure of the quantity of translated protein, or by a measure of gene product activity. Marker expression can be monitored in a variety of ways, including by detecting mRNA levels, protein levels, or protein activity, any of which can be measured using standard techniques. Detection can involve quantification of the level of gene expression (e.g., genomic DNA, cDNA, mRNA, protein, or enzyme activity), or, alternatively, can be a qualitative assessment of the level of gene expression, in particular in comparison with a control level. The type of level being detected will be clear from the context.

Methods of detecting and/or quantifying the gene transcript (mRNA or cDNA made therefrom) using nucleic acid hybridization techniques are known to those of skill in the art (see Sambrook et al. supra). For example, one method for evaluating the presence, absence, or quantity of cDNA involves a Southern transfer as described above. Briefly, the mRNA is isolated (e.g. using an acid guanidinium-phenol-chloroform extraction method, Sambrook et al. supra.) and reverse transcribed to produce cDNA. The cDNA is then optionally digested and run on a gel in buffer and transferred to membranes. Hybridization is then carried out using the nucleic acid probes specific for the target cDNA.

A general principle of such diagnostic and prognostic assays involves preparing a sample or reaction mixture that may contain a marker, and a probe, under appropriate conditions and for a time sufficient to allow the marker and probe to interact and bind, thus forming a complex that can be removed and/or detected in the reaction mixture. These assays can be conducted in a variety of ways.

For example, one method to conduct such an assay would involve anchoring the marker or probe onto a solid phase support, also referred to as a substrate, and detecting target marker/probe complexes anchored on the solid phase at the end of the reaction. In one embodiment of such a method, a sample from a subject, which is to be assayed for presence and/or concentration of marker, can be anchored onto a carrier or solid phase support. In another embodiment, the reverse situation is possible, in which the probe can be anchored to a solid phase and a sample from a subject can be allowed to react as an unanchored component of the assay.

There are many established methods for anchoring assay components to a solid phase. These include, without limitation, marker or probe molecules which are immobilized through conjugation of biotin and streptavidin. Such biotinylated assay components can be prepared from biotin-NHS(N-hydroxy-succinimide) using techniques known in the art (e.g., biotinylation kit, Pierce Chemicals, Rockford, Ill.), and immobilized in the wells of streptavidin-coated 96 well plates (Pierce Chemical). In certain embodiments, the surfaces with immobilized assay components can be prepared in advance and stored.

Other suitable carriers or solid phase supports for such assays include any material capable of binding the class of molecule to which the marker or probe belongs. Well-known supports or carriers include, but are not limited to, glass, polystyrene, nylon, polypropylene, nylon, polyethylene, dextran, amylases, natural and modified celluloses, polyacrylamides, gabbros, and magnetite.

In order to conduct assays with the above mentioned approaches, the non-immobilized component is added to the solid phase upon which the second component is anchored. After the reaction is complete, uncomplexed components may be removed (e.g., by washing) under conditions such that any complexes formed will remain immobilized upon the solid phase. The detection of marker/probe complexes anchored to the solid phase can be accomplished in a number of methods outlined herein.

In a preferred embodiment, the probe, when it is the unanchored assay component, can be labeled for the purpose of detection and readout of the assay, either directly or indirectly, with detectable labels discussed herein and which are well-known to one skilled in the art.

It is also possible to directly detect marker/probe complex formation without further manipulation or labeling of either component (marker or probe), for example by utilizing the technique of fluorescence energy transfer (see, for example, Lakowicz et al., U.S. Pat. No. 5,631,169; Stavrianopoulos, et al., U.S. Pat. No. 4,868,103). A fluorophore label on the first, 'donor' molecule is selected such that, upon excitation with incident light of appropriate wavelength, its emitted fluorescent energy will be absorbed by a fluorescent label on a second 'acceptor' molecule, which in turn is able to fluoresce due to the absorbed energy. Alternately, the 'donor' protein molecule may simply utilize the natural fluorescent energy of tryptophan residues. Labels are chosen that emit different wavelengths of light, such that the 'acceptor' molecule label may be differentiated from that of the 'donor'. Since the efficiency of energy transfer between the labels is related to the distance separating the molecules, spatial relationships between the molecules can be assessed. In a situation in which binding occurs between the molecules, the fluorescent emission of the 'acceptor' molecule label in the assay should be maximal. An FET binding event can be conveniently measured through standard fluorometric detection means well known in the art (e.g., using a fluorimeter).

In another embodiment, determination of the ability of a probe to recognize a marker can be accomplished without labeling either assay component (probe or marker) by utilizing a technology such as real-time Biomolecular Interaction Analysis (BIA) (see, e.g., Sjolander, S, and Urbaniczky, C., 1991, Anal. Chem. 63:2338-2345 and Szabo et al., 1995, Curr. Opin. Struct. Biol. 5:699-705). As used herein, "BIA" or "surface plasmon resonance" is a technology for studying biospecific interactions in real time, without labeling any of the interactants (e.g., BIAcore). Changes in the mass at the binding surface (indicative of a binding event) result in alterations of the refractive index of light near the surface (the optical phenomenon of surface plasmon resonance (SPR)), resulting in a detectable signal which can be used as an indication of real-time reactions between biological molecules.

Alternatively, in another embodiment, analogous diagnostic and prognostic assays can be conducted with marker and probe as solutes in a liquid phase. In such an assay, the complexed marker and probe are separated from uncomplexed components by any of a number of standard techniques, including but not limited to: differential centrifugation, chromatography, electrophoresis and immunoprecipitation. In differential centrifugation, marker/probe complexes may be separated from uncomplexed assay components through a series of centrifugal steps, due to the different sedimentation equilibria of complexes based on their different sizes and densities (see, for example, Rivas, G., and Minton, A. P., 1993, Trends Biochem Sci. 18(8):284-7). Standard chromatographic techniques may also be utilized to separate complexed molecules from uncomplexed ones. For example, gel filtration chromatography separates molecules based on size, and through the utilization of an appropriate gel filtration resin in a column format, for example, the relatively larger complex may be separated from the relatively smaller uncomplexed components. Similarly, the relatively different charge properties of the marker/probe complex as compared to the uncomplexed components may be exploited to differentiate the complex from uncomplexed components, for example through the utilization of ion-exchange chromatography resins. Such resins and chromatographic techniques are well known to one skilled in the art (see, e.g., Heegaard, N. H., 1998, J. Mol. Recognit. Winter 11 (1-6):141-8; Hage, D. S., and Tweed, S. A. J Chromatogr B Biomed Sci Appl 1997 Oct. 10; 699 (1-2):499-525). Gel electrophoresis may also be employed to separate complexed assay components from unbound components (see, e.g., Ausubel et al., ed., Current Protocols in Molecular Biology, John Wiley & Sons, New York, 1987-1999). In this technique, protein or nucleic acid complexes are separated based on size or charge, for example. In order to maintain the binding interaction during the electrophoretic process, non-denaturing gel matrix materials and conditions in the absence of reducing agent are typically preferred. Appropriate conditions to the particular assay and components thereof will be well known to one skilled in the art.

In a particular embodiment, the level of mRNA corresponding to the marker can be determined both by in situ and by in vitro formats in a biological sample using methods known in the art. The term "biological sample" is intended to include tissues, cells, biological fluids and isolates thereof, isolated from a subject, as well as tissues, cells and fluids present within a subject. Many expression detection methods use isolated RNA. For in vitro methods, any RNA isolation technique that does not select against the isolation of mRNA can be utilized for the purification of RNA from cells (see, e.g., Ausubel et al., ed., *Current Protocols in Molecular Biology*, John Wiley & Sons, New York 1987-1999). Additionally, large numbers of tissue samples can readily be processed using techniques well known to those of skill in the art, such as, for example, the single-step RNA isolation process of Chomczynski (1989, U.S. Pat. No. 4,843,155).

The isolated nucleic acid can be used in hybridization or amplification assays that include, but are not limited to, Southern or Northern analyses, polymerase chain reaction analyses and probe arrays. One preferred diagnostic method for the detection of mRNA levels involves contacting the isolated mRNA with a nucleic acid molecule (probe) that can hybridize to the mRNA encoded by the gene being detected. The nucleic acid probe can be, for example, a full-length cDNA, or a portion thereof, such as an oligonucleotide of at least 7, 15, 30, 50, 100, 250 or 500 nucleotides in length and sufficient to specifically hybridize under stringent conditions to a mRNA or genomic DNA encoding a marker of the present invention. Other suitable probes for use in the diagnostic assays of the invention are described herein. Hybridization of an mRNA with the probe indicates that the marker in question is being expressed.

In one format, the mRNA is immobilized on a solid surface and contacted with a probe, for example by running the isolated mRNA on an agarose gel and transferring the mRNA from the gel to a membrane, such as nitrocellulose. In an alternative format, the probe(s) are immobilized on a solid surface and the mRNA is contacted with the probe(s), for example, in an Affymetrix gene chip array. A skilled artisan can readily adapt known mRNA detection methods for use in detecting the level of mRNA encoded by the markers of the present invention.

The probes can be full length or less than the full length of the nucleic acid sequence encoding the protein. Shorter probes are empirically tested for specificity. Preferably nucleic acid probes are 20 bases or longer in length. (See, e.g., Sambrook et al. for methods of selecting nucleic acid probe sequences for use in nucleic acid hybridization.) Visualization of the hybridized portions allows the qualitative determination of the presence or absence of cDNA.

An alternative method for determining the level of a transcript corresponding to a marker of the present invention in a sample involves the process of nucleic acid amplification, e.g., by rtPCR (the experimental embodiment set forth in Mullis, 1987, U.S. Pat. No. 4,683,202), ligase chain reaction (Barany, 1991, *Proc. Natl. Acad. Sci. USA*, 88:189-193), self sustained sequence replication (Guatelli et al., 1990, *Proc. Natl. Acad. Sci. USA* 87:1874-1878), transcriptional amplification system (Kwoh et al., 1989, *Proc. Natl. Acad. Sci. USA* 86:1173-1177), Q-Beta Replicase (Lizardi et al., 1988, *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. Fluorogenic rtPCR may also be used in the methods of the invention. In fluorogenic rtPCR, quantitation is based on amount of fluorescence signals, e.g., TaqMan and sybr green. These detection schemes are especially useful for the detection of nucleic acid molecules if such molecules are present in very low numbers. As used herein, amplification primers are defined as being a pair of nucleic acid molecules that can anneal to 5' or 3' regions of a gene (plus and minus strands, respectively, or vice-versa) and contain a short region in between. In general, amplification primers are from about 10 to 30 nucleotides in length and flank a region from about 50 to 200 nucleotides in length. Under appropriate conditions and with appropriate reagents, such primers permit the amplification of a nucleic acid molecule comprising the nucleotide sequence flanked by the primers. For in situ methods, mRNA does not need to be isolated from the cells prior to detection. In such methods, a cell or tissue sample is prepared/processed using known histological methods. The sample is then immobilized on a support, typically a glass slide, and then contacted with a probe that can hybridize to mRNA that encodes the marker.

As an alternative to making determinations based on the absolute expression level of the marker, determinations may be based on the normalized expression level of the marker. Expression levels are normalized by correcting the absolute expression level of a marker by comparing its expression to the expression of a gene that is not a marker, e.g., a housekeeping gene that is constitutively expressed. Suitable genes for normalization include housekeeping genes such as the actin gene, or epithelial cell-specific genes. This normalization allows the comparison of the expression level in one sample, e.g., a subject sample, to another sample, e.g., a non-cancerous sample, or between samples from different sources.

Alternatively, the expression level can be provided as a relative expression level. To determine a relative expression level of a marker, the level of expression of the marker is determined for 10 or more samples of normal versus cancer cell isolates, preferably 50 or more samples, prior to the determination of the expression level for the sample in question. The mean expression level of each of the genes assayed in the larger number of samples is determined and this is used as a baseline expression level for the marker. The expression level of the marker determined for the test sample (absolute level of expression) is then divided by the mean expression value obtained for that marker. This provides a relative expression level.

Preferably, the samples used in the baseline determination will be from cancer cells or normal cells of the same tissue type. The choice of the cell source is dependent on the use of the relative expression level. Using expression found in normal tissues as a mean expression score aids in validating whether the marker assayed is specific to the tissue from which the cell was derived (versus normal cells). In addition, as more data is accumulated, the mean expression value can be revised, providing improved relative expression values based on accumulated data. Expression data from normal cells provides a means for grading the severity of the cancer state.

In another preferred embodiment, expression of a marker is assessed by preparing genomic DNA or mRNA/cDNA (i.e. a transcribed polynucleotide) from cells in a subject sample, and by hybridizing the genomic DNA or mRNA/cDNA with a reference polynucleotide which is a complement of a polynucleotide comprising the marker, and fragments thereof. cDNA can, optionally, be amplified using any of a variety of polymerase chain reaction methods prior to hybridization with the reference polynucleotide. Expression of one or more markers can likewise be detected using quantitative PCR (QPCR) to assess the level of expression of the marker(s). Alternatively, any of the many known methods of detecting mutations or variants (e.g. single nucleotide polymorphisms, deletions, etc.) of a marker of the invention may be used to detect occurrence of a mutated marker in a subject.

In a related embodiment, a mixture of transcribed polynucleotides obtained from the sample is contacted with a substrate having fixed thereto a polynucleotide complementary to or homologous with at least a portion (e.g. at least 7, 10, 15, 20, 25, 30, 40, 50, 100, 500, or more nucleotide residues) of a marker of the invention. If polynucleotides complementary to or homologous with are differentially detectable on the substrate (e.g. detectable using different chromophores or fluorophores, or fixed to different selected positions), then the levels of expression of a plurality of markers can be assessed simultaneously using a single substrate (e.g. a "gene chip" microarray of polynucleotides fixed at selected positions). When a method of assessing marker expression is used which involves hybridization of one nucleic acid with another, it is preferred that the hybridization be performed under stringent hybridization conditions.

In another embodiment, a combination of methods to assess the expression of a marker is utilized.

Because the compositions, kits, and methods of the invention rely on detection of a difference in expression levels or copy number of one or more markers of the invention, it is preferable that the level of expression or copy number of the marker is significantly greater than the minimum detection limit of the method used to assess expression or copy number in at least one of normal cells and cancerous cells.

3. Methods for Detection of Expressed Protein

The activity or level of a marker protein can also be detected and/or quantified by detecting or quantifying the expressed polypeptide. The polypeptide can be detected and quantified by any of a number of means well known to those of skill in the art. These may include analytic biochemical methods such as electrophoresis, capillary electrophoresis, high performance liquid chromatography (HPLC), thin layer chromatography (TLC), hyperdiffusion chromatography, and the like, or various immunological methods such as fluid or gel precipitin reactions, immunodiffusion (single or double), immunoelectrophoresis, radioimmunoassay (RIA), enzyme-linked immunosorbent assays (ELISAs), immunofluorescent assays, western blotting, and the like. A skilled artisan can readily adapt known protein/antibody detection methods for use in determining whether cells express a marker of the present invention.

A preferred agent for detecting a polypeptide of the invention is an antibody capable of binding to a polypeptide corresponding to a marker of the invention, preferably an antibody with a detectable label. Antibodies can be polyclonal, or more preferably, monoclonal. An intact antibody, or a fragment thereof (e.g., Fab or F(ab')$_2$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin.

In a preferred embodiment, the antibody is labeled, e.g. a radio-labeled, chromophore-labeled, fluorophore-labeled, or enzyme-labeled antibody). In another embodiment, an antibody derivative (e.g. an antibody conjugated with a substrate or with the protein or ligand of a protein-ligand pair {e.g. biotin-streptavidin}), or an antibody fragment (e.g. a single-chain antibody, an isolated antibody hypervariable domain, etc.) which binds specifically with a protein corresponding to the marker, such as the protein encoded by the open reading frame corresponding to the marker or such a protein which has undergone all or a portion of its normal post-translational modification, is used.

Proteins from cells can be isolated using techniques that are well known to those of skill in the art. The protein isolation methods employed can, for example, be such as those described in Harlow and Lane (Harlow and Lane, 1988, *Antibodies: A Laboratory Manual*, Cold Spring Harbor Laboratory Press, Cold Spring Harbor, N.Y.).

In one format, antibodies, or antibody fragments, can be used in methods such as Western blots or immunofluorescence techniques to detect the expressed proteins. In such uses, it is generally preferable to immobilize either the antibody or proteins on a solid support. Suitable solid phase supports or carriers include any support capable of binding an antigen or an antibody. Well-known supports or carriers include glass, polystyrene, polypropylene, polyethylene, dextran, nylon, amylases, natural and modified celluloses, polyacrylamides, gabbros, and magnetite.

One skilled in the art will know many other suitable carriers for binding antibody or antigen, and will be able to adapt such support for use with the present invention. For example, protein isolated from cells can be run on a polyacrylamide gel electrophoresis and immobilized onto a solid phase support such as nitrocellulose. The support can then be washed with suitable buffers followed by treatment with the detectably labeled antibody. The solid phase support can then be washed with the buffer a second time to remove unbound antibody. The amount of bound label on the solid support can then be detected by conventional means. Means of detecting proteins using electrophoretic techniques are well known to those of skill in the art (see generally, R. Scopes (1982) Protein Purification, Springer-Verlag, N.Y.; Deutscher, (1990) Methods in Enzymology Vol. 182: Guide to Protein Purification, Academic Press, Inc., N.Y.).

In another preferred embodiment, Western blot (immunoblot) analysis is used to detect and quantify the presence of a polypeptide in the sample. This technique generally comprises separating sample proteins by gel electrophoresis on the basis of molecular weight, transferring the separated proteins to a suitable solid support, (such as a nitrocellulose filter, a nylon filter, or derivatized nylon filter), and incubating the sample with the antibodies that specifically bind a polypeptide. The anti-polypeptide antibodies specifically bind to the polypeptide on the solid support. These antibodies may be directly labeled or alternatively may be subsequently detected using labeled antibodies (e.g., labeled sheep anti-mouse antibodies) that specifically bind to the anti-polypeptide.

In a more preferred embodiment, the polypeptide is detected using an immunoassay. As used herein, an immunoassay is an assay that utilizes an antibody to specifically bind to the analyte. The immunoassay is thus characterized by detection of specific binding of a polypeptide to an antibody as opposed to the use of other physical or chemical properties to isolate, target, and quantify the analyte.

The polypeptide is detected and/or quantified using any of a number of well recognized immunological binding assays (see, e.g., U.S. Pat. Nos. 4,366,241; 4,376,110; 4,517,288; and 4,837,168). For a review of the general immunoassays, see also Asai (1993) Methods in Cell Biology Volume 37: Antibodies in Cell Biology, Academic Press, Inc. New York; Stites & Terr (1991) Basic and Clinical Immunology 7th Edition.

Immunological binding assays (or immunoassays) typically utilize a "capture agent" to specifically bind to and often immobilize the analyte (polypeptide or subsequence). The capture agent is a moiety that specifically binds to the analyte. In a preferred embodiment, the capture agent is an antibody that specifically binds a polypeptide. The antibody (anti-peptide) may be produced by any of a number of means well known to those of skill in the art.

Immunoassays also often utilize a labeling agent to specifically bind to and label the binding complex formed by the capture agent and the analyte. The labeling agent may itself be one of the moieties comprising the antibody/analyte complex. Thus, the labeling agent may be a labeled polypeptide or a labeled anti-antibody. Alternatively, the labeling agent may be a third moiety, such as another antibody, that specifically binds to the antibody/polypeptide complex.

In one preferred embodiment, the labeling agent is a second human antibody bearing a label. Alternatively, the second antibody may lack a label, but it may, in turn, be bound by a labeled third antibody specific to antibodies of the species from which the second antibody is derived. The second can be modified with a detectable moiety, e.g. as biotin, to which a third labeled molecule can specifically bind, such as enzyme-labeled streptavidin.

Other proteins capable of specifically binding immunoglobulin constant regions, such as protein A or protein G may also be used as the label agent. These proteins are normal constituents of the cell walls of streptococcal bacteria. They exhibit a strong non-immunogenic reactivity with immunoglobulin constant regions from a variety of species (see, generally Kronval, et al. (1973) J. Immunol., 111: 1401-1406, and Akerstrom (1985) J. Immunol., 135: 2589-2542).

As indicated above, immunoassays for the detection and/or quantification of a polypeptide can take a wide variety of formats well known to those of skill in the art.

Preferred immunoassays for detecting a polypeptide are either competitive or noncompetitive. Noncompetitive immunoassays are assays in which the amount of captured analyte is directly measured. In one preferred "sandwich" assay, for example, the capture agent (anti-peptide antibodies) can be bound directly to a solid substrate where they are immobilized. These immobilized antibodies then capture polypeptide present in the test sample. The polypeptide thus immobilized is then bound by a labeling agent, such as a second human antibody bearing a label.

In competitive assays, the amount of analyte (polypeptide) present in the sample is measured indirectly by measuring the amount of an added (exogenous) analyte (polypeptide) displaced (or competed away) from a capture agent (anti peptide antibody) by the analyte present in the sample. In one competitive assay, a known amount of, in this case, a polypeptide is added to the sample and the sample is then contacted with a capture agent. The amount of polypeptide bound to the antibody is inversely proportional to the concentration of polypeptide present in the sample.

In one particularly preferred embodiment, the antibody is immobilized on a solid substrate. The amount of polypeptide bound to the antibody may be determined either by measuring the amount of polypeptide present in a polypeptide/antibody complex, or alternatively by measuring the amount of remaining uncomplexed polypeptide. The amount of polypeptide may be detected by providing a labeled polypeptide.

The assays of this invention are scored (as positive or negative or quantity of polypeptide) according to standard methods well known to those of skill in the art. The particular method of scoring will depend on the assay format and choice of label. For example, a Western Blot assay can be scored by visualizing the colored product produced by the enzymatic label. A clearly visible colored band or spot at the correct molecular weight is scored as a positive result, while the absence of a clearly visible spot or band is scored as a negative. The intensity of the band or spot can provide a quantitative measure of polypeptide.

Antibodies for use in the various immunoassays described herein, can be produced as described below.

In another embodiment, level (activity) is assayed by measuring the enzymatic activity of the gene product. Methods of assaying the activity of an enzyme are well known to those of skill in the art.

In vivo techniques for detection of a biomarker protein include introducing into a subject a labeled antibody directed against the protein. For example, the antibody can be labeled with a radioactive marker whose presence and location in a subject can be detected by standard imaging techniques.

Certain markers identified by the methods of the invention may be secreted proteins. It is a simple matter for the skilled artisan to determine whether any particular marker protein is a secreted protein. In order to make this determination, the marker protein is expressed in, for example, a mammalian cell, preferably a human cell line, extracellular fluid is collected, and the presence or absence of the protein in the extracellular fluid is assessed (e.g. using a labeled antibody which binds specifically with the protein).

The following is an example of a method which can be used to detect secretion of a protein. About $8 \times 10^5$ 293T cells are incubated at 37° C. in wells containing growth medium (Dulbecco's modified Eagle's medium {DMEM} supplemented with 10% fetal bovine serum) under a 5% (v/v) CO2, 95% air atmosphere to about 60-70% confluence. The cells are then transfected using a standard transfection mixture comprising 2 micrograms of DNA comprising an expression vector encoding the protein and 10 microliters of LipofectAMINE™ (GIBCO/BRL Catalog no. 18342-012) per well. The transfection mixture is maintained for about 5 hours, and then replaced with fresh growth medium and maintained in an air atmosphere. Each well is gently rinsed twice with DMEM which does not contain methionine or cysteine (DMEM-MC; ICN Catalog no. 16-424-54). About 1 milliliter of DMEM-MC and about 50 microcuries of Trans-$^{35}$S™ reagent (ICN Catalog no. 51006) are added to each well. The wells are maintained under the 5% $CO_2$ atmosphere described above and incubated at 37° C. for a selected period. Following incubation, 150 microliters of conditioned medium is removed and centrifuged to remove floating cells and debris. The presence of the protein in the supernatant is an indication that the protein is secreted.

It will be appreciated that subject samples, e.g., a sample containing tissue, whole blood, serum, plasma, buccal scrape, saliva, cerebrospinal fluid, urine, stool, bile, pancreatic juice, and pancreatic tissue, may contain cells therein, particularly when the cells are cancerous, and, more particularly, when the cancer is metastasizing, and thus may be used in the methods of the present invention. The cell sample can, of course, be subjected to a variety of well-known post-collection preparative and storage techniques (e.g., nucleic acid and/or protein extraction, fixation, storage, freezing, ultrafiltration, concentration, evaporation, centrifugation, etc.) prior to assessing the level of expression of the marker in the sample. Thus, the compositions, kits, and methods of the invention can be used to detect expression of markers corresponding to proteins having at least one portion which is displayed on the surface of cells which express it. It is a simple matter for the skilled artisan to determine whether the protein corresponding to any particular marker comprises a cell-surface protein. For example, immunological methods may be used to detect such proteins on whole cells, or well known computer-based sequence analysis methods (e.g. the SIGNALP program;

Nielsen et al., 1997, *Protein Engineering* 10:1-6) may be used to predict the presence of at least one extracellular domain (i.e. including both secreted proteins and proteins having at least one cell-surface domain). Expression of a marker corresponding to a protein having at least one portion which is displayed on the surface of a cell which expresses it may be detected without necessarily lysing the cell (e.g. using a labeled antibody which binds specifically with a cell-surface domain of the protein).

The invention also encompasses kits for detecting the presence of a polypeptide or nucleic acid corresponding to a marker of the invention in a biological sample, e.g., a sample containing tissue, whole blood, serum, plasma, buccal scrape, saliva, cerebrospinal fluid, urine, stool, bile, pancreatic juice, and pancreatic tissue. Such kits can be used to determine if a subject is suffering from or is at increased risk of developing cancer. For example, the kit can comprise a labeled compound or agent capable of detecting a polypeptide or an mRNA encoding a polypeptide corresponding to a marker of the invention in a biological sample and means for determining the amount of the polypeptide or mRNA in the sample (e.g., an antibody which binds the polypeptide or an oligonucleotide probe which binds to DNA or mRNA encoding the polypeptide). Kits can also include instructions for interpreting the results obtained using the kit.

For antibody-based kits, the kit can comprise, for example: (1) a first antibody (e.g., attached to a solid support) which binds to a polypeptide corresponding to a marker of the invention; and, optionally, (2) a second, different antibody which binds to either the polypeptide or the first antibody and is conjugated to a detectable label.

For oligonucleotide-based kits, the kit can comprise, for example: (1) an oligonucleotide, e.g., a detectably labeled oligonucleotide, which hybridizes to a nucleic acid sequence encoding a polypeptide corresponding to a marker of the invention or (2) a pair of primers useful for amplifying a nucleic acid molecule corresponding to a marker of the invention. The kit can also comprise, e.g., a buffering agent, a preservative, or a protein stabilizing agent. The kit can further comprise components necessary for detecting the detectable label (e.g., an enzyme or a substrate). The kit can also contain a control sample or a series of control samples which can be assayed and compared to the test sample. Each component of the kit can be enclosed within an individual container and all of the various containers can be within a single package, along with instructions for interpreting the results of the assays performed using the kit.

4. Method for Detecting Structural Alterations

The invention also provides a method for assessing whether a subject is afflicted with cancer or is at risk for developing cancer by comparing the structural alterations, e.g., mutations or allelic variants, of a marker in a cancer sample with the structural alterations, e.g., mutations of a marker in a normal, e.g., control sample. The presence of a structural alteration, e.g., mutation or allelic variant in the marker in the cancer sample is an indication that the subject is afflicted with cancer.

A preferred detection method is allele specific hybridization using probes overlapping the polymorphic site and having about 5, 10, 20, 25, or 30 nucleotides around the polymorphic region. In a preferred embodiment of the invention, several probes capable of hybridizing specifically to allelic variants are attached to a solid phase support, e.g., a "chip". Oligonucleotides can be bound to a solid support by a variety of processes, including lithography. For example a chip can hold up to 250,000 oligonucleotides (GeneChip, Affymetrix™). Mutation detection analysis using these chips comprising oligonucleotides, also termed "DNA probe arrays" is described e.g., in Cronin et al. (1996) Human Mutation 7:244. In one embodiment, a chip comprises all the allelic variants of at least one polymorphic region of a gene. The solid phase support is then contacted with a test nucleic acid and hybridization to the specific probes is detected. Accordingly, the identity of numerous allelic variants of one or more genes can be identified in a simple hybridization experiment. For example, the identity of the allelic variant of the nucleotide polymorphism in the 5' upstream regulatory element can be determined in a single hybridization experiment.

In other detection methods, it is necessary to first amplify at least a portion of a marker prior to identifying the allelic variant. Amplification can be performed, e.g., by PCR and/or LCR (see Wu and Wallace (1989) *Genomics* 4:560), according to methods known in the art. In one embodiment, genomic DNA of a cell is exposed to two PCR primers and amplification for a number of cycles sufficient to produce the required amount of amplified DNA. In preferred embodiments, the primers are located between 150 and 350 base pairs apart.

Alternative amplification methods include: self sustained sequence replication (Guatelli, J. C. et al., (1990) *Proc. Natl. Acad. Sci. USA* 87:1874-1878), transcriptional amplification system (Kwoh, D. Y. et al., (1989) *Proc. Natl. Acad. Sci. USA* 86:1173-1177), Q-Beta Replicase (Lizardi, P. M. et al., (1988) Bio/Technology 6:1197), and self-sustained sequence replication (Guatelli et al., (1989)*Proc. Nat. Acad. Sci.* 87:1874), and nucleic acid based sequence amplification (NABSA), or any other nucleic acid amplification method, followed by the detection of the amplified molecules using techniques well known to those of skill in the art. These detection schemes are especially useful for the detection of nucleic acid molecules if such molecules are present in very low numbers.

In one embodiment, any of a variety of sequencing reactions known in the art can be used to directly sequence at least a portion of a marker and detect allelic variants, e.g., mutations, by comparing the sequence of the sample sequence with the corresponding reference (control) sequence. Exemplary sequencing reactions include those based on techniques developed by Maxam and Gilbert (*Proc. Natl. Acad Sci USA* (1977) 74:560) or Sanger (Sanger et al. (1977) *Proc. Nat. Acad. Sci.* 74:5463). It is also contemplated that any of a variety of automated sequencing procedures may be utilized when performing the subject assays (*Biotechniques* (1995) 19:448), including sequencing by mass spectrometry (see, for example, U.S. Pat. No. 5,547,835 and international patent application Publication Number WO 94/16101, entitled DNA Sequencing by Mass Spectrometry by H. Köster; U.S. Pat. No. 5,547,835 and international patent application Publication Number WO 94/21822 entitled "DNA Sequencing by Mass Spectrometry Via Exonuclease Degradation" by H. Köster), and U.S. Pat. No. 5,605,798 and International Patent Application No. PCT/US96/03651 entitled DNA Diagnostics Based on Mass Spectrometry by H. Köster; Cohen et al. (1996) *Adv Chromatogr* 36:127-162; and Griffin et al. (1993) *Appl Biochem Biotechnol* 38:147-159). It will be evident to one skilled in the art that, for certain embodiments, the occurrence of only one, two or three of the nucleic acid bases need be determined in the sequencing reaction. For instance, A-track or the like, e.g., where only one nucleotide is detected, can be carried out.

Yet other sequencing methods are disclosed, e.g., in U.S. Pat. No. 5,580,732 entitled "Method of DNA sequencing employing a mixed DNA-polymer chain probe" and U.S. Pat. No. 5,571,676 entitled "Method for mismatch-directed in vitro DNA sequencing."

In some cases, the presence of a specific allele of a marker in DNA from a subject can be shown by restriction enzyme analysis. For example, a specific nucleotide polymorphism can result in a nucleotide sequence comprising a restriction site which is absent from the nucleotide sequence of another allelic variant.

In a further embodiment, protection from cleavage agents (such as a nuclease, hydroxylamine or osmium tetroxide and with piperidine) can be used to detect mismatched bases in RNA/RNA DNA/DNA, or RNA/DNA heteroduplexes (Myers, et al. (1985) *Science* 230:1242). In general, the technique of "mismatch cleavage" starts by providing heteroduplexes formed by hybridizing a control nucleic acid, which is optionally labeled, e.g., RNA or DNA, comprising a nucleotide sequence of a marker allelic variant with a sample nucleic acid, e.g., RNA or DNA, obtained from a tissue sample. The double-stranded duplexes are treated with an agent which cleaves single-stranded regions of the duplex such as duplexes formed based on basepair mismatches between the control and sample strands. For instance, RNA/DNA duplexes can be treated with RNase and DNA/DNA hybrids treated with S1 nuclease to enzymatically digest the mismatched regions. In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine whether the control and sample nucleic acids have an identical nucleotide sequence or in which nucleotides they are different. See, for example, Cotton et al (1988) *Proc. Natl Acad Sci USA* 85:4397; Saleeba et al (1992) *Methods Enzymol.* 217:286-295. In a preferred embodiment, the control or sample nucleic acid is labeled for detection.

In another embodiment, an allelic variant can be identified by denaturing high-performance liquid chromatography (DHPLC) (Oefner and Underhill, (1995) *Am. J. Human Gen.* 57:Suppl. A266). DHPLC uses reverse-phase ion-pairing chromatography to detect the heteroduplexes that are generated during amplification of PCR fragments from individuals who are heterozygous at a particular nucleotide locus within that fragment (Oefner and Underhill (1995) *Am. J. Human Gen.* 57:Suppl. A266). In general, PCR products are produced using PCR primers flanking the DNA of interest. DHPLC analysis is carried out and the resulting chromatograms are analyzed to identify base pair alterations or deletions based on specific chromatographic profiles (see O'Donovan et al. (1998) *Genomics* 52:44-49).

In other embodiments, alterations in electrophoretic mobility is used to identify the type of marker allelic variant. For example, single strand conformation polymorphism (SSCP) may be used to detect differences in electrophoretic mobility between mutant and wild type nucleic acids (Orita et al. (1989) *Proc Natl. Acad. Sci. USA* 86:2766, see also Cotton (1993) *Mutat Res* 285:125-144; and Hayashi (1992) *Genet Anal Tech Appl* 9:73-79). Single-stranded DNA fragments of sample and control nucleic acids are denatured and allowed to renature. The secondary structure of single-stranded nucleic acids varies according to sequence, the resulting alteration in electrophoretic mobility enables the detection of even a single base change. The DNA fragments may be labeled or detected with labeled probes. The sensitivity of the assay may be enhanced by using RNA (rather than DNA), in which the secondary structure is more sensitive to a change in sequence. In another preferred embodiment, the subject method utilizes heteroduplex analysis to separate double stranded heteroduplex molecules on the basis of changes in electrophoretic mobility (Keen et al. (1991) *Trends Genet.* 7:5).

In yet another embodiment, the identity of an allelic variant of a polymorphic region is obtained by analyzing the movement of a nucleic acid comprising the polymorphic region in polyacrylamide gels containing a gradient of denaturant is assayed using denaturing gradient gel electrophoresis (DGGE) (Myers et al. (1985) *Nature* 313:495). When DGGE is used as the method of analysis, DNA will be modified to insure that it does not completely denature, for example by adding a GC clamp of approximately 40 bp of high-melting GC-rich DNA by PCR. In a further embodiment, a temperature gradient is used in place of a denaturing agent gradient to identify differences in the mobility of control and sample DNA (Rosenbaum and Reissner (1987) *Biophys Chem* 265: 1275).

Examples of techniques for detecting differences of at least one nucleotide between two nucleic acids include, but are not limited to, selective oligonucleotide hybridization, selective amplification, or selective primer extension. For example, oligonucleotide probes may be prepared in which the known polymorphic nucleotide is placed centrally (allele-specific probes) and then hybridized to target DNA under conditions which permit hybridization only if a perfect match is found (Saiki et al. (1986) *Nature* 324:163); Saiki et al (1989) *Proc. Natl. Acad. Sci. USA* 86:6230; and Wallace et al. (1979) *Nucl. Acids Res.* 6:3543). Such allele specific oligonucleotide hybridization techniques may be used for the simultaneous detection of several nucleotide changes in different polymorphic regions of marker. For example, oligonucleotides having nucleotide sequences of specific allelic variants are attached to a hybridizing membrane and this membrane is then hybridized with labeled sample nucleic acid. Analysis of the hybridization signal will then reveal the identity of the nucleotides of the sample nucleic acid.

Alternatively, allele specific amplification technology which depends on selective PCR amplification may be used in conjunction with the instant invention. Oligonucleotides used as primers for specific amplification may carry the allelic variant of interest in the center of the molecule (so that amplification depends on differential hybridization) (Gibbs et al (1989) *Nucleic Acids Res.* 17:2437-2448) or at the extreme 3' end of one primer where, under appropriate conditions, mismatch can prevent, or reduce polymerase extension (Prossner (1993) *Tibtech* 11:238; Newton et al. (1989) *Nucl. Acids Res.* 17:2503). This technique is also termed "PROBE" for Probe Oligo Base Extension. In addition it may be desirable to introduce a novel restriction site in the region of the mutation to create cleavage-based detection (Gasparini et al (1992) *Mol. Cell. Probes* 6:1).

In another embodiment, identification of the allelic variant is carried out using an oligonucleotide ligation assay (OLA), as described, e.g., in U.S. Pat. No. 4,998,617 and in Landegren, U. et al., (1988) *Science* 241:1077-1080. The OLA protocol uses two oligonucleotides which are designed to be capable of hybridizing to abutting sequences of a single strand of a target. One of the oligonucleotides is linked to a separation marker, e.g., biotinylated, and the other is detectably labeled. If the precise complementary sequence is found in a target molecule, the oligonucleotides will hybridize such that their termini abut, and create a ligation substrate. Ligation then permits the labeled oligonucleotide to be recovered using avidin, or another biotin ligand. Nickerson, D. A. et al. have described a nucleic acid detection assay that combines attributes of PCR and OLA (Nickerson, D. A. et al., (1990) *Proc. Natl. Acad. Sci.* (U.S.A.) 87:8923-8927. In this method, PCR is used to achieve the exponential amplification of target DNA, which is then detected using OLA.

The invention further provides methods for detecting single nucleotide polymorphisms in a marker. Because single nucleotide polymorphisms constitute sites of variation flanked by regions of invariant sequence, their analysis requires no more than the determination of the identity of the single nucleotide present at the site of variation and it is unnecessary to determine a complete gene sequence for each subject. Several methods have been developed to facilitate the analysis of such single nucleotide polymorphisms.

In one embodiment, the single base polymorphism can be detected by using a specialized exonuclease-resistant nucleotide, as disclosed, e.g., in Mundy, C. R. (U.S. Pat. No. 4,656,127). According to the method, a primer complementary to the allelic sequence immediately 3' to the polymorphic site is permitted to hybridize to a target molecule obtained from a particular animal or human. If the polymorphic site on the target molecule contains a nucleotide that is complementary to the particular exonuclease-resistant nucleotide derivative present, then that derivative will be incorporated onto the end of the hybridized primer. Such incorporation renders the primer resistant to exonuclease, and thereby permits its detection. Since the identity of the exonuclease-resistant derivative of the sample is known, a finding that the primer has become resistant to exonucleases reveals that the nucleotide present in the polymorphic site of the target molecule was complementary to that of the nucleotide derivative used in the reaction. This method has the advantage that it does not require the determination of large amounts of extraneous sequence data.

In another embodiment of the invention, a solution-based method is used for determining the identity of the nucleotide of a polymorphic site. Cohen, D. et al. (French Patent 2,650,840; PCT Appln. No. WO91/02087). As in the Mundy method of U.S. Pat. No. 4,656,127, a primer is employed that is complementary to allelic sequences immediately 3' to a polymorphic site. The method determines the identity of the nucleotide of that site using labeled dideoxynucleotide derivatives, which, if complementary to the nucleotide of the polymorphic site will become incorporated onto the terminus of the primer.

An alternative method, known as Genetic Bit Analysis or GBA™ is described by Goelet, P. et al. (PCT Appln. No. 92/15712). The method of Goelet, P. et al. uses mixtures of labeled terminators and a primer that is complementary to the sequence 3' to a polymorphic site. The labeled terminator that is incorporated is thus determined by, and complementary to, the nucleotide present in the polymorphic site of the target molecule being evaluated. In contrast to the method of Cohen et al. (French Patent 2,650,840; PCT Appln. No. WO91/02087) the method of Goelet, P. et al. is preferably a heterogeneous phase assay, in which the primer or the target molecule is immobilized to a solid phase.

Several primer-guided nucleotide incorporation procedures for assaying polymorphic sites in DNA have been described (Komher, J. S. et al., (1989) Nucl. Acids. Res. 17:7779-7784; Sokolov, B. P., (1990) Nucl. Acids Res. 18:3671; Syvanen, A.-C., et al., (990) Genomics 8:684-692; Kuppuswamy, M. N. et al., (1991) Proc. Natl. Acad. Sci. (U.S.A.) 88:1143-1147; Prezant, T. R. et al., (1992) Hum. Mutat. 1:159-164; Ugozzoli, L. et al., (1992) GATA 9:107-112; Nyren, P. (1993) et al., Anal Biochem. 208:171-175). These methods differ from GBA™ in that they all rely on the incorporation of labeled deoxynucleotides to discriminate between bases at a polymorphic site. In such a format, since the signal is proportional to the number of deoxynucleotides incorporated, polymorphisms that occur in runs of the same nucleotide can result in signals that are proportional to the length of the run (Syvanen, A. C., et al., (1993) Amer. J. Hum. Genet. 52:46-59).

For determining the identity of the allelic variant of a polymorphic region located in the coding region of a marker, yet other methods than those described above can be used. For example, identification of an allelic variant which encodes a mutated marker can be performed by using an antibody specifically recognizing the mutant protein in, e.g., immunohistochemistry or immunoprecipitation. Antibodies to wild-type marker or mutated forms of markers can be prepared according to methods known in the art.

Alternatively, one can also measure an activity of a marker, such as binding to a marker ligand. Binding assays are known in the art and involve, e.g., obtaining cells from a subject, and performing binding experiments with a labeled ligand, to determine whether binding to the mutated form of the protein differs from binding to the wild-type of the protein.

B. Pharmacogenomics

Agents or modulators which have a stimulatory or inhibitory effect on amount and/or activity of a marker of the invention can be administered to individuals to treat (prophylactically or therapeutically) cancer in the subject. In conjunction with such treatment, the pharmacogenomics (i.e., the study of the relationship between an individual's genotype and that individual's response to a foreign compound or drug) of the individual may be considered. Differences in metabolism of therapeutics can lead to severe toxicity or therapeutic failure by altering the relation between dose and blood concentration of the pharmacologically active drug. Thus, the pharmacogenomics of the individual permits the selection of effective agents (e.g., drugs) for prophylactic or therapeutic treatments based on a consideration of the individual's genotype. Such pharmacogenomics can further be used to determine appropriate dosages and therapeutic regimens. Accordingly, the amount, structure, and/or activity of the invention in an individual can be determined to thereby select appropriate agent(s) for therapeutic or prophylactic treatment of the individual.

Pharmacogenomics deals with clinically significant variations in the response to drugs due to altered drug disposition and abnormal action in affected persons. See, e.g., Linder (1997) Clin. Chem. 43(2):254-266. In general, two types of pharmacogenetic conditions can be differentiated. Genetic conditions transmitted as a single factor altering the way drugs act on the body are referred to as "altered drug action." Genetic conditions transmitted as single factors altering the way the body acts on drugs are referred to as "altered drug metabolism". These pharmacogenetic conditions can occur either as rare defects or as polymorphisms. For example, glucose-6-phosphate dehydrogenase (G6PD) deficiency is a common inherited enzymopathy in which the main clinical complication is hemolysis after ingestion of oxidant drugs (anti-malarials, sulfonamides, analgesics, nitrofurans) and consumption of fava beans.

As an illustrative embodiment, the activity of drug metabolizing enzymes is a major determinant of both the intensity and duration of drug action. The discovery of genetic polymorphisms of drug metabolizing enzymes (e.g., N-acetyl-transferase 2 (NAT 2) and cytochrome P450 enzymes CYP2D6 and CYP2C19) has provided an explanation as to why some subjects do not obtain the expected drug effects or show exaggerated drug response and serious toxicity after taking the standard and safe dose of a drug. These polymorphisms are expressed in two phenotypes in the population, the extensive metabolizer (EM) and poor metabolizer (PM). The prevalence of PM is different among different populations. For example, the gene coding for CYP2D6 is highly polymorphic and several mutations have been identified in PM, which all lead to the absence of functional CYP2D6. Poor metabolizers of CYP2D6 and CYP2C19 quite frequently experience exaggerated drug response and side effects when they receive standard doses. If a metabolite is the active therapeutic moiety, a PM will show no therapeutic response, as demonstrated for the analgesic effect of codeine mediated by its CYP2D6-formed metabolite morphine. The other extreme are the so called ultra-rapid metabolizers who do not respond to standard doses. Recently, the molecular basis of ultra-rapid metabolism has been identified to be due to CYP2D6 gene amplification.

Thus, the amount, structure, and/or activity of a marker of the invention in an individual can be determined to thereby select appropriate agent(s) for therapeutic or prophylactic treatment of the individual. In addition, pharmacogenetic studies can be used to apply genotyping of polymorphic alleles encoding drug-metabolizing enzymes to the identification of an individual's drug responsiveness phenotype. This knowledge, when applied to dosing or drug selection, can avoid adverse reactions or therapeutic failure and thus enhance therapeutic or prophylactic efficiency when treating a subject with a modulator of amount, structure, and/or activity of a marker of the invention.

C. Monitoring Clinical Trials

Monitoring the influence of agents (e.g., drug compounds) on amount, structure, and/or activity of a marker of the invention can be applied not only in basic drug screening, but also in clinical trials. For example, the effectiveness of an agent to affect marker amount, structure, and/or activity can be monitored in clinical trials of subjects receiving treatment for cancer. In a preferred embodiment, the present invention provides a method for monitoring the effectiveness of treatment of a subject with an agent (e.g., an agonist, antagonist, peptidomimetic, protein, peptide, antibody, nucleic acid, antisense nucleic acid, ribozyme, small molecule, RNA interfering agent, or other drug candidate) comprising the steps of (i) obtaining a pre-administration sample from a subject prior to administration of the agent; (ii) detecting the amount, structure, and/or activity of one or more selected markers of the invention in the pre-administration sample; (iii) obtaining one or more post-administration samples from the subject; (iv) detecting the amount, structure, and/or activity of the marker(s) in the post-administration samples; (v) comparing the level of expression of the marker(s) in the pre-administration sample with the amount, structure, and/or activity of the marker(s) in the post-administration sample or samples; and (vi) altering the administration of the agent to the subject accordingly. For example, increased administration of the agent can be desirable to increase amount and/or activity of the marker(s) to higher levels than detected, i.e., to increase the effectiveness of the agent. Alternatively, decreased administration of the agent can be desirable to decrease amount and/or activity of the marker(s) to lower levels than detected, i.e., to decrease the effectiveness of the agent.

EXAMPLES

This invention is further illustrated by the following examples which should not be construed as limiting. The contents of all references, figures, Sequence Listing, patents and published patent applications cited throughout this application are hereby incorporated by reference.

Example 1

A. Materials and Methods
Primary Tumors and Cell Lines

All cell lines were acquired from the American Type Culture Collection (ATCC) or the German Collection of Microorganisms and Cell Cultures (DSMZ). All fresh-frozen specimens of primary pancreatic ductal adenocarcinoma were obtained from the Memorial Sloan-Kettering Cancer Center tumor bank and histology was confirmed by hematoxylin and eosin (H&E) staining prior to inclusion in the study (Table 2). Table 2 lists the cell lines analyzed by array-CGH and expression profiling in the study.

Array-CGH Profiling on cDNA Microarrays

Genomic DNA was fragmented and random-prime labeled according to published protocol (Pollack, J. R., et al. (1999) *Nat Genet.* 23, 41-6) with modifications. Labeled DNAs were hybridized to human cDNA microarrays containing 14,160 cDNA clones (Agilent Technologies™, Human 1 clone set), for which approximately 9,420 unique map positions were defined (NCBI, Build 33). The median interval between mapped elements is 100.1 kilobase, 92.8% of intervals are less than 1 megabase, and 98.6% are less than 3 megabases.

Figure 4:
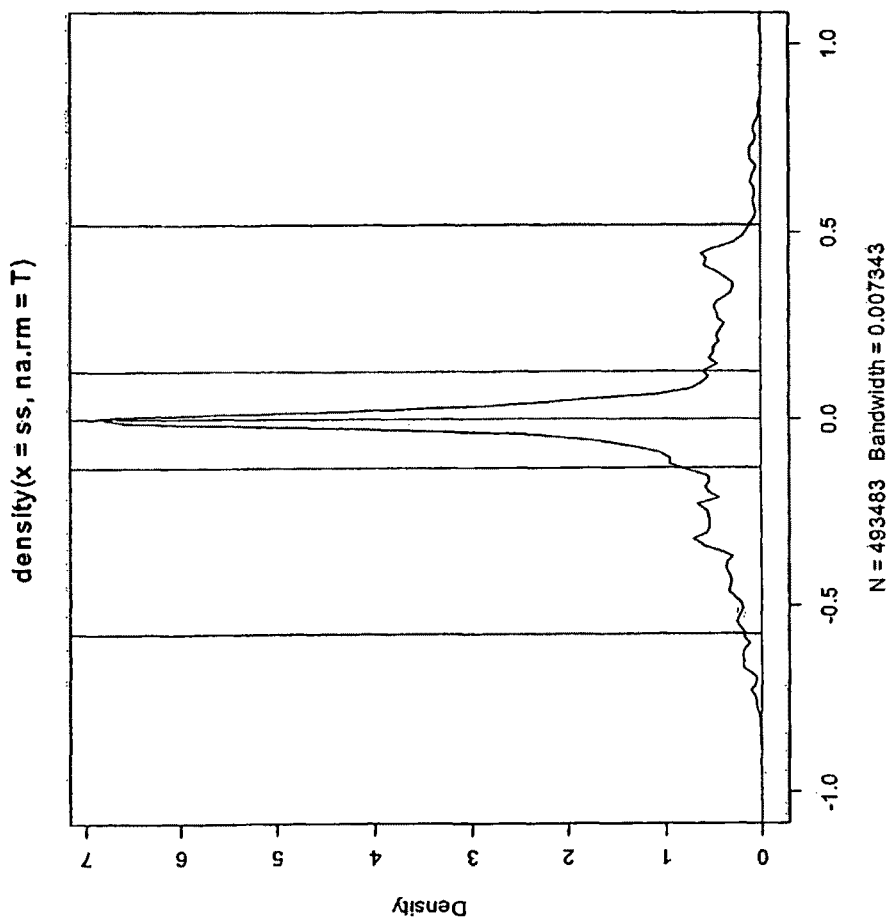
FIG. 4 depicts a histogram of segmented profiles showing the peak at a $Log_2$ ratio of 0 as a result of mode centering. Outer lines mark 3% (del) and 97% (amp) quantiles; inner lines mark +/−4 standard deviation of middle 50% of data.

Fluorescence ratios of scanned images of the arrays were calculated and the raw array-CGH profiles were processed to identify statistically significant transitions in copy number using a segmentation algorithm which employs permutation to determine the significance of change points in the raw data (Olshen, A. B., and Venkatraman, E. S. (2002) *ASA Proceedings of the Joint Statistical Meetings*, 2530-2535; Ginzinger, D. G. (2002) *Exp Hematol* 30, 503-12). Each segment was assigned a $Log_2$ ratio that is the median of the contained probes. The data was centered by the tallest mode in the distribution of the segmented values. After mode-centering, gains and losses were defined as $Log_2$ ratios of greater than or equal to +0.13 or −0.13 (+/−4 standard deviations of the middle 50% quantile of data), and amplification and deletion as ratio greater than 0.52 or less than −0.58, respectively (i.e., 97% or 3% quantiles) (FIG. 4).

Automated Locus Definition

Loci were defined by an automated algorithm applied to the segmented data based on the following rules:

1. Segments above $97^{th}$ percentile or below $3^{rd}$ percentile were identified as altered.

2. If two or more altered segments are adjacent in a single profile or separated by less than 500 KB, the entire region spanned by the segments was considered to be an altered span.

3. Highly altered segments or spans that were shorter than 20 MB were retained as "informative spans" for defining discrete locus boundaries. Longer regions were not discarded, but were not included in defining locus boundaries.

4. Informative spans were compared across samples to identify overlapping groups of positive-value or negative-value segments; each group defined a locus.

5. Minimal common regions (MCRs) were defined as contiguous spans having at least 75% of the peak recurrence as calculated by counting the occurrence of highly altered segments. If two MCRs were separated by a gap of only one probe position, they were joined. If there were more than 3 MCRs in a locus, the whole region was reported as a single complex MCR.

MCR Characterization

For each MCR, the peak segment value was identified. Recurrence of gain or loss was calculated across all samples based on the lower thresholds previously defined (~+/−0.13). As an additional measure of recurrence independent of thresholds for segment value or length, Median Aberration (MA) was calculated for each probe position by taking the median of all segment values above zero for amplified regions, below zero for deleted regions. This pair of values was compared to the distribution of values obtained after permuting the probe labels independently in each sample profile. Where the magnitude of the MA exceeds 95% of the permuted averages, the region was marked as significantly gained or lost, and this was used in the voting system for prioritization. The number of known genes and GENSCAN model predicted genes were counted based on the April 2003 human assembly at UCSC (genome.ucsc.edu).

QPCR Verification

PCR primers were designed to amplify products of 100-150 bp within target and control sequences. Primers for control sequences in each cell line were designed within a region of euploid copy number as shown by array-CGH analysis. Quantitative PCR was performed by monitoring in real-time the increase in fluorescence of SYBR Green dye (Qiagen™) with an ABI 7700 sequence detection system (Perkin Elmer Life Sciences™). Relative gene copy number was calculated by the comparative $C_t$ method (Ginzinger, D. G. (2002) Exp Hematol 30, 503-12).

Expression Profiling on Affymetrix GeneChip™

Biotinylated target cRNA was generated from total sample RNA and hybridized to human oligonucleotide probe arrays (U133A, Affymetrix™, Santa Clara, Calif.) according to standard protocols (Golub, T. R., et al. (1999) Science 286, 531-7). Expression values for each gene were standardized by Log2 ratio to a middle value for the sample set, defined as the midpoint between 25% and 75% quantiles, and were mapped to genomic positions based on NCBI Build 33 of the human genome.

Integrated Copy Number and Expression Analysis

Array-CGH data was interpolated such that each expression value can be mapped to its corresponding copy number value. In order to maximize detection of focal CNAs, two separate interpolations were calculated: one selecting the higher bounding CGH probe and one choosing the lower. For each gene position, the samples were grouped based on whether array-CGH shows altered copy number or not based on interpolated CGH value. The effect of gene dosage on expression was measured by calculating a gene weight defined as the difference of the means of the expression value in the altered and unaltered sample groups divided by the sum of the standard deviations of the expression values in altered and unaltered sample groups (Hyman, E., et al. (2002) Cancer Res 62, 6240-5). The significance of the weight for each gene was estimated by permuting the sample labels 10,000 times and applying an alpha threshold of 0.05.

B. Results

Comprehensive Catalogue of CNAs in the Pancreatic Adenocarcinoma Genome

Figure 5:
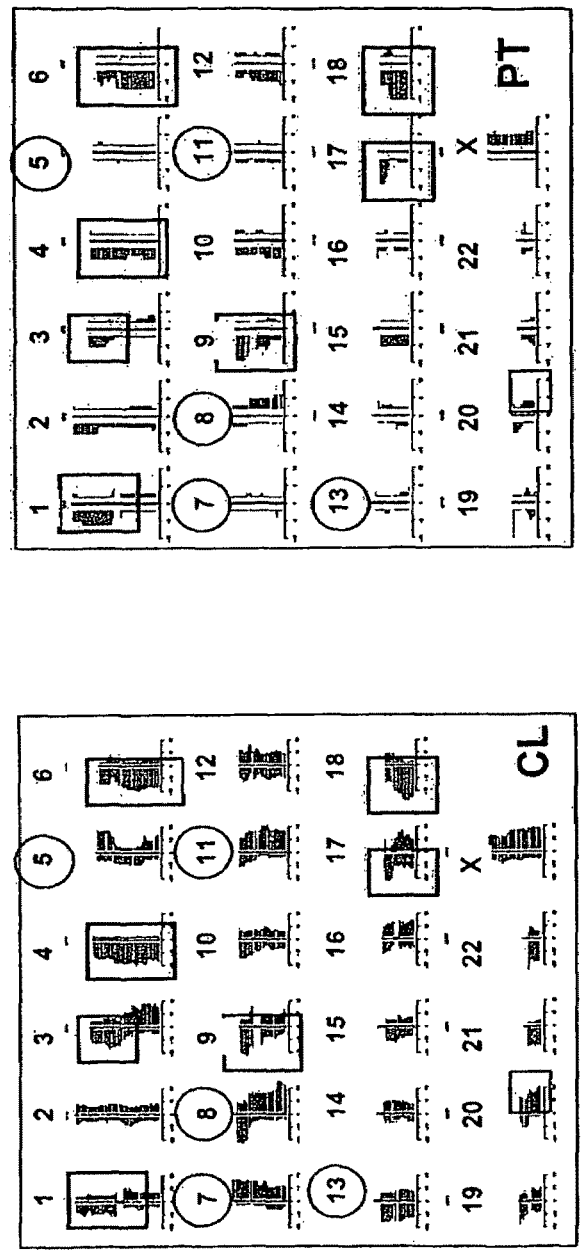
FIG. 5 depicts a comparison of array-CGH profiles of pancreatic adenocarcinoma primary tumors and cell lines. A pseudo-karyotype presentation of an integer-value recurrence plot by chromosome is shown here for both primary tumors (PT) and cell lines (CL). Gain is shown on the right of the chromosome and loss on the left of the chromosome. Important regions of similarity between PT and CL are highlighted with boxes and chromosomes with prominent discrepancies between PT and CL are circled.
Figure 6:
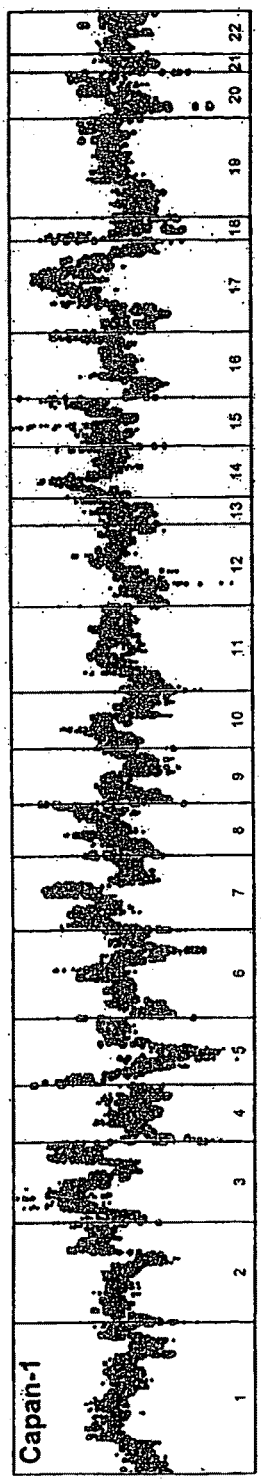
FIG. 6 depicts a whole-genome correlation of copy number and expression in the cell line Capan-1. Median filtered (width=31 probes) array-CGH and expression data are indicated in light blue and gold, respectively. Note that fluctuations in average gene expression correlate with changes in chromosome copy number (R=0.66).

From a total of 75 primary pancreatic tumor specimens, 13 samples were identified that possessed greater than 60% neoplastic cellularity. Genomic DNAs from these primary tumor samples, along with DNAs derived from 24 established pancreatic cancer cell lines, e.g., pancreatic adenocarcinoma cell lines (Table 2), were subjected to genome-wide array-CGH profiling using a cDNA-based array platform that offers a median resolution of 100 kB. To facilitate identification of significant copy number events in these array-CGH profiles, a modified version of the circular binary segmentation methodology developed by Olshen and colleagues was employed (Olshen, A. B., and Venkatraman, E. S. (2002) ASA Proceedings of the Joint Statistical Meetings 2530-2535; Ginzinger, D. G. (2002) Exp Hematol 30, 503-12; Golub, T. R., et al. (1999) Science 286, 531-7; Hyman, E., et al. (2002) Cancer Res 62, 6240-5; Lucito, R., et al. (2003) Genome Res 13, 2291-305). This algorithm applies nonparametric statistical testing to identify and distinguish discrete copy number transition points from chance noise events in the primary dataset. As shown in FIG. 1A, the segmented array-CGH profiles readily identified large regional changes that are typically of low amplitude, hereafter referred to as 'gain' or 'loss'. Similarly, focal high amplitude alterations representing 'amplification' or 'deletion' are evident in both primary tumor specimens and tumor cell lines (FIG. 1). Recurrence frequencies of the CNAs reported here match the frequencies described in the published literature (Solinas-Toldo, S., et al. (1996) Cancer Res 56, 3803-7; Mahlamaki, E. H., et al. (1997) Genes Chromosomes Cancer 20, 383-91; Mahlamaki, E. H., et al. (2002) Genes Chromosomes Cancer 35, 353-8; Fukushige, S., et al. (1997) Genes Chromosomes Cancer 19:161-9; Curtis, L. J., et al. (1998) Genomics 53, 42-55; Ghadimi, B. M., et al. (1999) Am J Pathol 154, 525-36; Armengol, G., et al. (2000) Cancer Genet Cytogenet 116, 133-41) (FIG. 1B). There is also strong concordance between primary tumors and cell lines with respect to gains on 3q, 8q and 20q and losses on 1p, 3p, 6q, 9p, 17p and 18q (see FIG. 5 and FIG. 6). However, some differences were evident between primary tumor and cell line datasets and are likely attributable to the cellular heterogeneity within primary tumor samples and/or culture-induced genetic adaptation in the cell lines.

The identification of many novel CNAs, along with the high degree of structural complexity within each CNA, prompted the implementation of objective criteria to define and prioritize CNAs across the dataset. To that end, a locus-identification algorithm was developed that defines informative CNAs on the basis of size and achievement of a high significance threshold for the amplitude of change. Overlapping CNAs from multiple profiles are then merged in an automated fashion to define a discrete "locus" of regional copy number change, the bounds of which represent the combined physical extent of these overlapping CNAs (FIG. 1C). Each locus is characterized by a peak profile, the width and amplitude of which reflect the contour of the most prominent amplification or deletion for that locus. Furthermore, within each locus, one or more minimal common region (MCRs) can be identified across multiple tumor samples (FIG. 1C), with each MCR potentially harboring a distinct cancer-relevant gene targeted for copy number alteration across the sample set.

The locus identification algorithm is highly effective in delineating more discrete CNAs within previously described larger regions of gain or loss. For example, chromosome 6q has been reported as one of the most frequently deleted regions in pancreatic adenocarcinoma, but no validated tumor suppressor gene has yet been assigned to this locus. Analysis of 6q loss in the dataset presented herein has identified 5 distinct MCRs that range in size from 2.4 to 12.8 Mb, raising the possibility that there may be multiple targets for 6q loss. Notably, two of these MCRs (Table 3, Locus #75 and #76) coincide with previously identified regions of common allelic loss (Abe, T., et al. (1999) Genes Chromosomes Cancer 25, 60-4), an observation that provides further validation for the analytical approach described herein.

Selection of High-Priority Loci

The above locus-identification algorithm defined 287 discrete MCRs (from 256 independent autosomal loci) within this dataset and annotated each in terms of recurrence, amplitude of change and representation in both cell lines and primary tumors. Based upon extensive experience with this platform across many tumor types, recurrence across multiple independent samples and high amplitude signals are the two features most predictive of verification by independent assays. Hence, these discrete MCRs were prioritized based on four criteria that include (1) recurrence of high-threshold amplification or deletion (above $97^{th}$ percentile or below $3^{rd}$ percentile) in at least two specimens, (2) presence of a high-threshold event in at least one primary tumor specimen, (3) statistically significant Median Aberration (see M&M), and (4) a peak amplitude of equal to or greater than absolute $\text{Log}_2$ value of 0.8 in either a cell line or primary tumor (beyond 0.5% quantiles).

Implementation of this prioritization scheme yielded 64 MCRs within 54 independent loci that satisfied at least three of the four criteria (Table 1). In Table 1, the high-confidence recurrent CNAs in pancreatic adenocarcinoma are depicted. For each MCR, the numbers of known ("K") and predicted ("P") (GenScan) transcripts ("Trspt") are indicated. Of these, some are represented on Affymetrix™ U133A chip ("Total"), a subset of which show statistical significance (p<0.05) for copy number correlation ("Sig"). MCR recurrence is denoted as percentage of the total dataset. The numbers of primary tumors (T) or cell lines (C) with gain or loss, and amplification or deletion, are listed, respectively. Candidate genes within a locus for which there is literature support for involvement in pancreatic cancer are listed. Black diamonds denote the loci where the peak did not fall within a defined MCR. MCRs in bold have been validated by QPCR. Notably, genes known to play important roles in the pathogenesis of pancreatic adenocarcinoma—the $\text{p16}^{INK4A}$ and TP53 tumor suppressors and the MYC, KRAS2 and AKT2 oncogenes—were present within these high-confidence loci (Table 1). Within the prioritized MCRs, there was an average recurrence rate for gain/loss of 38% across the entire dataset and the maxima or minima absolute $\text{Log}_2$ values for 34 of these 64 MCRs are greater than 1.0, placing them significantly above the threshold defined for amplification or deletion (FIG. 4). In the majority of cases, the peak profile of a locus coincided with one of the MCRs (47 of 54 Loci, Table 1) (Albertson, D. G., et al. (2000) Nat Genet. 25, 144-6). The median size of these 64 prioritized MCRs is 2.7 Mb, with 21 MCRs (33%) spanning 1 Mb or less (Table 1). Residing within these 21 highly focal MCRs with a median size of 0.33 Mb, there are on average 15 annotated and 8 GENSCAN predicted genes, rendering them highly attractive for target identification.

Figure 2:
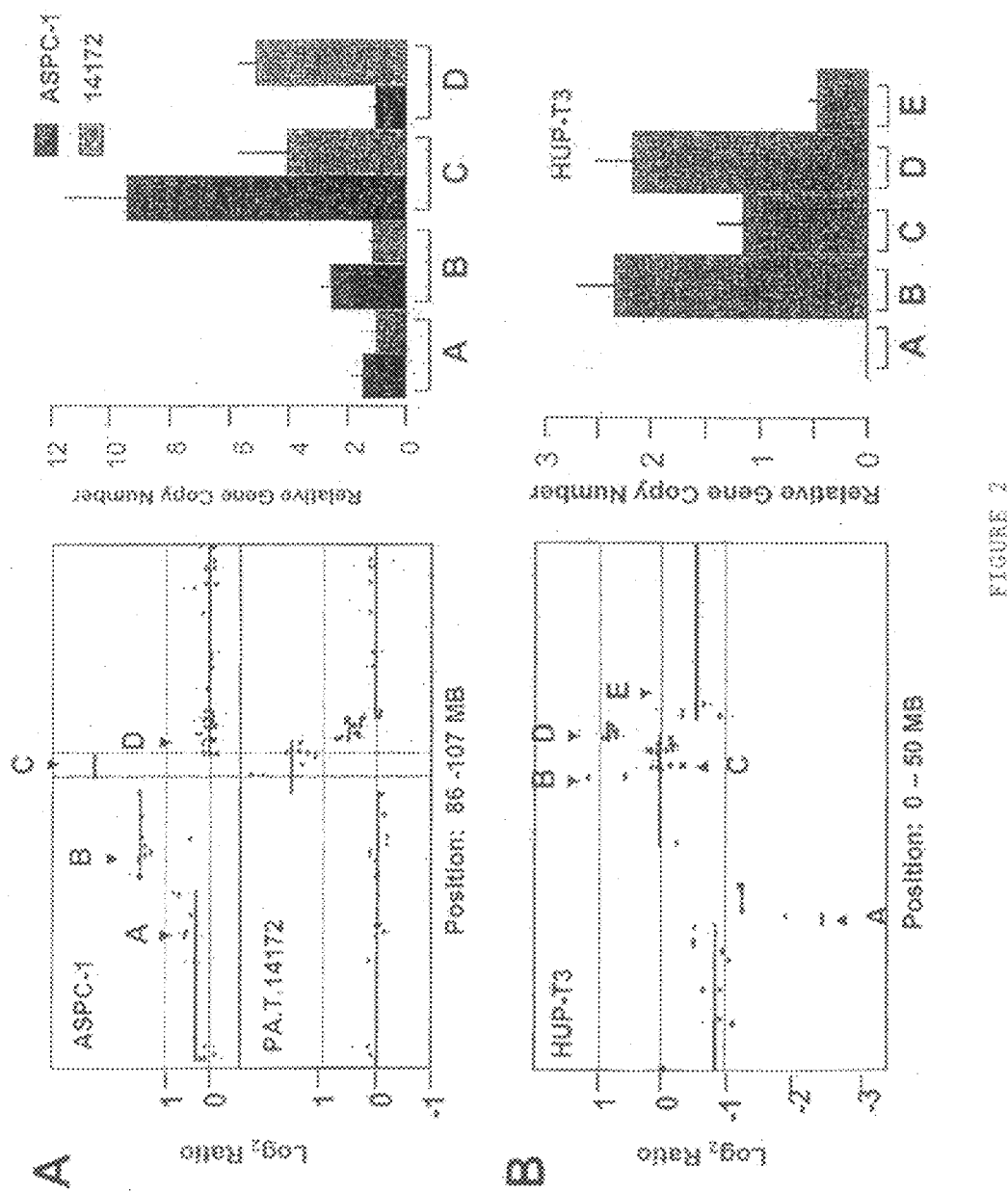
FIGS. 2A-2B depict that QPCR verifies complexity within CNAs. (2A) Chromosome 7 CGH profiles (Left panel) showing amplification of a discrete region of 7q22 in both the AsPC-1 cell line and PA.T.14172 (Locus # 9, Table 1), with MCR defined by both samples (outlined by dashed lines). Letters A-D indicate the relative positions of QPCR assays (Right panel), which confirm the gene copy alterations in AsPC-1 (dark gray bars) and PA.T.14172 (light gray bars). (2B) Chromosome 9 array-CGH profile (Left panel) for a complex CNA in the HUP-T3 cell line. Homozygous deletion of the known target $p16^{Ink4a}$ is confirmed by QPCR (Right panel), which also verifies the existence of two discrete, focal amplicons and a narrow region of one-copy loss revealed by array-CGH. Note that CNAs covered by only one or two probes are not identified by the segmentation algorithm.

The confidence-level ascribed to these prioritized loci was further validated by real-time quantitative PCR (QPCR), which demonstrated 100% concordance with 16 selected MCRs defined by array-CGH (Table 1). For example, the MCR of an amplified locus at 7q21.11-7q32.2 was readily confirmed by QPCR (FIG. 2A). Furthermore, QPCR analyses also verified the structural details of complex CNAs reported by array-CGH. As shown in FIG. 2B, QPCR precisely mirrored each component of the complex 9p21 locus in HUP-T3, including homozygous deletion of $\text{p16}^{INK4A}$, the known target for this CNA. Such detailed structural information will prove useful in dissecting the mechanisms responsible for the genesis of these cancer-associated chromosomal aberrations.

When high-priority MCRs in Table 1 were combined with an additional 81 moderate-priority MCRs (within 66 distinct loci) satisfying 2 out of 4 criteria, a genomic characterization produced a list of 145 MCRs within 121 independent loci (Table 3). Table 3 shows the combined list of 145 MCRs in 121 independent loci, including 64 high-confidence MCRs (≥3 votes) and 81 moderate-priority (2 votes) MCRs, that were prioritized by the automated algorithm as described herein. Each locus is assigned to a cytogenetic band, while the actual extent of the locus is defined more precisely by its physical location on the chromosome (in Mb) (NCBI, Built 33). The overall contour of the locus is reflected by the maxima/minima profile, which defines the most prominent point of amplification or deletion within the locus by its width (defined in physical Mb) and amplitude. Each locus is furthered defined by one or more Minimal Common Regions (MCRs), depending on the cytogenetic complexity of the locus. Each MCR is defined in a similar manner. In addition, the number of known and predicted (GENSCAN) transcripts as well as the total number of Affymetrix-represented genes and those with p-value<0.05 are shown for each MCR. MCR recurrence is denoted as percentage of the total dataset. The number of primary tumors (T) or cell lines (C) with gain or loss (90% and 10% quantiles, respectively) is listed. Furthermore, the subset of these tumors with gain/loss that meet the threshold for amplification or deletion (97% and 3% quantiles, respectively) are also indicated. The boundaries of the MCRs of each locus have been defined based on conservative parameters.

Integrated Analysis of Copy Number and Expression Information.

Figure 3:
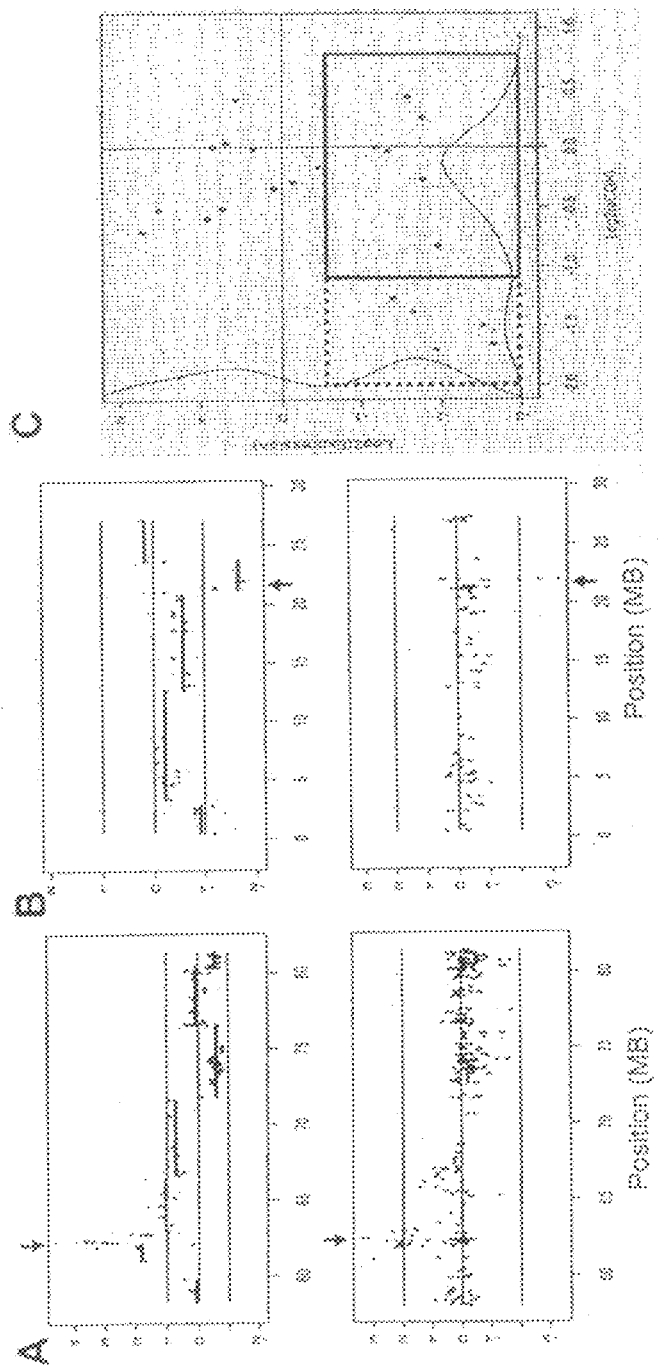
FIGS. 3A-3C depict that combined array-CGH and expression analysis facilitates identification of candidate genes. (3A) Analysis of 17q23.2-25.3 locus (Locus #21, Table 1) in cell line Hup T3. Top panel: array-CGH profile of HUP-T3. Bottom panel: Expression profile of genes on Affymetrix U133A array within the specified locus for the HUP-T3 cell line. The subset of genes exhibiting prominent gene-dosage correlated expression fall within the peak of the locus (arrows). (3B) Analysis of 9p24.3-21.2 locus (Locus #41, Table 1) in the cell line BxPC-3. Top panel: array-CGH profile of 9p region. Bottom panel: Affymetrix™ expression profile of genes mapping to the same region. Note the dramatically reduced expression of the $p16^{INK4A}$ gene (arrows) within the MCR. (3C) Correlation of $p16^{INK4A}$ expression and copy number in 24 cell lines was analyzed. Note the bimodal distribution of both expression values and copy number values for this gene across all samples (green lines). The box outlined in dots defines those samples (BxPC-3, MiaPaCa, Capan 1, Hup-T3 and Dan-G) in which $p16^{INK4A}$ is homozygously deleted and not expressed. The box outlined in solid lines encloses samples (Panc-1, Panc 03.27, SW1990, Panc 08.13, Hup-T4 and Panc 02.13) in which $p16^{INK4A}$ is present but with absent or reduced expression.

Copy number aberrations and their associated impact on gene expression patterns represent a common mechanism of oncogene activation and tumor suppressor inactivation. Indeed, integration of copy number and transcriptional profile datasets revealed a consistent influence of gene dosage on mRNA expression globally across the genome (FIG. 6) (Hyman, E., et al. (2002) Cancer Res 62, 6240-5; Pollack, J. R., et al. (2002) Proc Natl Acad Sci USA 99, 12963-8). Conversely, as previously demonstrated (Platzer, P., et al. (2002) Cancer Res 62, 1134-8), only a subset of genes within any given CNA show copy-number-driven expression changes—a feature that provides a first-pass means of distinguishing bystanders from potential cancer gene targets within the CNA. As a case in point, a novel locus of amplification on chromosome 17 in the cell line Hup-T3 (Locus #21, Table 1) contains 455 genes of which 151 are present on the Affymetrix U133A array. Of these 151 genes, only 19 exhibited increased transcript levels above 2-fold. Moreover, these 19 genes reside within the peak of this locus (FIG. 3A). Similar correlations can be established in regions of deletion. For example, the 9p21 deletion locus in the BxPC-3 cell line demonstrated that only 5 out of 91 genes residing within the MCR show undetectable or decreased expression below 2-fold (FIG. 3B). Examination of $\text{p16}^{INK4A}$, the known target for deletion, across the entire sample set shows that 11 of 24 cell lines show low or absent expression, of which 5 showed homozygous deletion while the remaining 6 were present at the DNA level (FIG. 3C). In the latter, epigenetic silencing is the presumed mechanism of $\text{p16}^{INK4a}$ inactivation.

In many cancer types, including pancreatic adenocarcinoma, the true cell-of-origin remains unknown and thus a premalignant physiological frame-of-reference is not available. In the examples above, a model for interfacing copy number and expression profiles by midpoint-centering the expression data and calculating a weighted statistic for assignment of significance values to genes with correlated copy number and expression was applied (Golub, T. R., et al. (1999) Science 286, 531-7; Hyman, E., et al. (2002) Cancer Res 62, 6240-5) (see M&M). Using this approach, the genes residing within the 64 high-confidence MCRs (Table 1) were prioritized based on the correlation of their expression with gene dosage. While only a subset of genes are represented, the Affymetrix™ U133A array permitted inclusion of 1,926 genes out of a total of 4,742 genes residing within these MCRs for this analysis. By weighing each of these 1,926 genes based on the magnitude of its expression alteration and its representation within CNAs across the dataset, the integrated copy number and expression analysis yielded a list of 603 genes that show a statistically significant association between gene copy number and mRNA expression (p<0.05, Tables 4 and 5). Tables 4 and 5 show the genes located within high-priority MCRs (Table 1) and having highly significant correlation between gene expression and gene dosage (p<0.05). The chromosome, physical position in Mb, Gene Weight (see M&M) and p-value are listed. Affymetrix probe(s) number(s) corresponding to each GenBank Accession Number ("GI" Number) and UniGene ID are listed, along with SEQ ID NOs for each nucleic acid and protein sequence. P-Values were calculated by permutation analysis of a gene weight statistic. Of these, 336 are located within regions of amplifications and 267 within regions of deletions. Importantly, among these 603 genes were known pancreatic cancer genes such as MYC (13), p16$^{INK4A}$ (Rozenblum, E., et al. (1997) Cancer Res 57, 1731-4; Caldas, C., et al. (1994) Nat Genet. 8, 27-32) and DUSP6 (Furukawa, T., et al. (2003) Am J Pathol 162, 1807-15) (Tables 4 and 5), thus reinforcing the value of integrating both copy number and expression information.

While incomplete representation of known and predicted genes on the Affymetrix U133A expression array precluded assessment of all possible target genes, the complementary analysis of array-CGH and expression profiles presented herein serves to prioritize the list of available cancer gene candidates and provides a basis for focus on a subset of high-probability candidates. In addition, integrating genomic datasets across species may also prove effective in facilitating cancer gene identification. A particularly productive path for oncogene identification may be the analysis of common integration sites (CISs) present in retrovirally-promoted leukemias and lymphomas (Neil, J. C. & Cameron, E. R. (2002) Cancer Cell 2, 253-5). Consistent with the paradigm that proviral integration primarily serves to activate endogenous proto-oncogene (Neil, J. C. & Cameron, E. R. (2002) Cancer Cell 2, 253-5), syntenic mapping of 232 CISs to the human genome (Akagi K., et al. (2004) Nucl. Acids Res 32) uncovered 19 CISs residing within MCRs of amplified loci in Table 1, whereas only 10 would be expected by chance alone ($p<0.006$). On the contrary, MCRs within regions of loss or deletion contained only 16 CIS's whereas 14.4 would have been expected by chance alone. Thus, the abundance of CIS's mapping to amplified loci may represent genes with pathogenetic relevance in mouse models of tumor progression as well as in human cancer, although there may be possible cell-type specific roles for these candidate genes.

Equivalents

Those skilled in the art will recognize, or be able to ascertain using no more than routine experimentation, many equivalents to the specific embodiments of the invention described herein. Such equivalents are intended to be encompassed by the following claims.

TABLE 1

List of High-Confidence MCRs.

| # | Cytogenetic Band | Locus Boundary (Mb) | Locus Peak Profile Pos (MB) | Max/Min | Minimal Common Regions (MCRs) Position (MB) | Size (MB) |
|---|---|---|---|---|---|---|
| | | | Gain and Amplification | | | |
| 1 | 1p13.1-p12 | 116.83-119.49 | 119.07-119.2 | 1.56 | 116.83-119.49 | 2.65 |
| 2 | 5p15.33-p15.31 | 0.28-6.69 | 0.28-0.51 | 0.79 | 0.28-6.69 | 6.4 |
| 3 | 5q31.1-q31.1 | 133.51-134.33 | 133.58-133.95 | 0.97 | 133.53-133.56 | 0.04 |
| 4 | 6p22.1-p21.32 | 28.12-32.72 | 31.98-32.44 | 1.36 | 31.98-32.11 | 0.13 |
| 5 | 6p21.1-p21.1 | 42.91-43.19 | 42.98-43.15 | 0.84 | 42.91-43.03 | 0.12 |
| 6 | 7p22.3-p22.1 | 0.72-4.53 | 0.72-2.48 | 0.93 | 0.72-2.28 | 1.56 |
| 7 | 7p15.1-p14.3 | 30.12-31.56 | 30.5-30.81 | 0.82 | 30.12-31.66 | 1.44 |
| 8 | 7q11.21-q21.11 | 64.84-77.18 | 64.95-64.95 | 1.06 | 64.95-65.85 | 0.9 |
| 9 | 7q21.11-q32.2 | 79.45-129.46 | 97.86-98.55 | 3.06 | 92.33-112.27 | 19.94 |
| 10 | 8p12-p11.21 | 37.7-41.76 | 37.72-38.02 | 1.71 | 37.7-38.45 | 0.75 |
| | | | | | 38.68-39.52 | 0.84 |
| 11 | 8q12.1-q12.3 | 59.09-63.68 | 59.23-62.26 | 0.58 | 59.23-60.02 | 1.6 |
| 12 | 8q21.3-q24.3 | 90.7-145.83 | 133.72-134.16 | 1.78 | 118.97-145.83 | 26.86 |
| 13 | 9p21.3-p13.2 | 23.68-37.87 | 35.65-36.56 | 0.86 | 35.6-36.56 | 0.96 |
| 14 | 11q14.1-q14.2 | 78.15-86.74 | 82.76-85.89 | 0.9 | 83.39-86.21 | 2.82 |
| 15 | 12p12.3-q13.13 | 16.6-53.06 | 20.7-22.54 | 2.52 | 21.82-22.39 | 0.57 |
| 16 | 12q15-q15 | 68.27-68.87 | 68.44-68.77 | 1.38 | 68.27-68.85 | 0.59 |
| 17 | 13q12.11-q14.13 | 18.68-43.95 | 19.21-24.22 | 0.89 | 20.65-24.85 | 4.19 |
| 18 | 13q34-q34 | 112.84-113.06 | 112.85-113.01 | 0.82 | 112.84-113.06 | 0.23 |
| 19 | 14q11.2-q24.3 | 18.82-74.47 | 73.56-74.47* | 1.08 | 28.12-33.17 | 5.05 |
| | | | | | 52.41-63.53 | 11.12 |
| 20 | 17q12-q23.2 | 37.48-56.39 | 43.53-43.53 | 2.37 | 38.95-55.26 | 16.31 |
| 21 | 17q23.2-q25.3 | 59.83-79.64 | 62.33-62.47* | 3.61 | 74.02-74.22 | 0.2 |
| 22 | 18p11.21-q12.1 | 12.02-28.55 | 19.67-21.37 | 2.12 | 19.12-21.37 | 2.26 |
| 23 | 19p13.11-q13.32 | 23.32-50 | 45.03-45.39* | 3.84 | 41.41-44.6 | 3.2 |
| 24 | 19q13.32-q13.43 | 50.06-63.76 | 50.65-50.65 | 1.59 | 50.06-62.89 | 12.83 |
| 25 | 20p13-q13.33 | 0.33-63.41 | 58.54-63.41 | 1.34 | 25.68-31.48 | 5.8 |
| | | | | | 58.24-63.41 | 6.17 |
| 26 | 22q11.1-q12.1 | 14.65-26.58 | 22.7-22.7 | 1.04 | 22.64-22.83 | 0.2 |
| 27 | 22q12.2-q12.2 | 28.75-29.85 | 28.96-29.83 | 0.93 | 29.35-29.85 | 0.51 |
| | | | Loss and Deletion | | | |
| 28 | 1p36.21-p36.11 | 15.02-26.95 | 21.46-21.46 | -0.94 | 21.08-21.56 | 0.48 |
| | | | | | 22.82-26.95 | 4.13 |
| 29 | 1p36.3-p34.3 | 28.37-39.18 | 32.79-33.04 | -0.87 | 28.37-31.18 | 2.81 |
| | | | | | 32.67-34.68 | 2.01 |
| 30 | 1p21.2-p21.1 | 100.63-103.3 | 103.25-103.25 | -1.69 | 103.25-103.3 | 0.05 |
| 31 | 2p25.3-p24.3 | 0.21-16.09 | 10.92-11.3 | -0.85 | 11.3-11.32 | 0.02 |
| 32 | 2p12-p11.2 | 75.23-89 | 79.31-85.51* | -1.03 | 77.7-79.27 | 1.57 |
| 33 | 3p26.3-p24.3 | 1.33-18.8 | 13.85-14.52 | -1 | 13.67-14.52 | 0.85 |

TABLE 1-continued

List of High-Confidence MCRs.

| # | Region | Max Min | | | | |
|---|---|---|---|---|---|---|
| 34 | 4q31.22-q32.1 | 148.03-158.75 | 149.46-153.1 | −0.93 | 151.71-154.37 | 2.65 |
|  |  |  |  |  | 155.09-158.56 | 3.47 |
| 35 | 4q34.1-q35.2 | 174.84-188.09 | 175.03-187.79 | −1.28 | 174.84-188.09 | 13.26 |
| 36 | 5q23.2-q23.3 | 127.55-130.53 | 127.65-128.48 | −0.62 | 127.55-130.53 | 2.98 |
| 37 | 6q21-q22.31 | 106.63-119.43 | 107.02-116.57 | −1.11 | 106.63-119.43 | 12.8 |
| 38 | 6q23.3-q24.3 | 135.17-146.81 | 137.46-138.13 | −0.91 | 135.17-146.81 | 11.64 |
| 39 | 6q27-q27 | 168.07-170.64 | 168.63-170.64 | −0.72 | 168.07-170.64 | 2.47 |
| 40 | 8p23.3-p12 | 2.06-37.7 | 2.06-2.1* | −1.86 | 18.07-21.76 | 3.68 |
|  |  |  |  |  | 28.45-37.7 | 9.25 |
| 41 | 9p24.3-p21.2 | 0.47-27.18 | 20.77-21.31 | −2.63 | 0.47-3.39 | 2.92 |
|  |  |  |  |  | 6.3-23.68 | 18.39 |
| 42 | 11q14.2-q14.3 | 85.89-89.24 | 86.21-89.24 | −0.9 | 85.89-89.24 | 3.35 |
| 43 | 12q12-q13.12 | 40.06-49.24 | 41.04-49.21 | −0.71 | 40.06-49.24 | 9.18 |
| 44 | 12q13.12-q13.3 | 49.65-55.82 | 50.01-53.06 | −0.7 | 49.65-63.06 | 3.41 |
|  |  |  |  |  | 63.17-55.82 | 2.65 |
| 45 | 12q14.1-q15 | 67.92-68.77 | 62.76-68.27 | −0.8 | 62.76-68.77 | 6.01 |
| 46 | 12q21.2-q24.33 | 77.19-133.4 | 81.03-85.63 | −1.19 | 77.19-91.44 | 14.25 |
| 47 | 16p13.3-p12.2 | 0.03-23.87 | 0.76-23.7 | −0.67 | 2.24-2.82 | 0.58 |
| 48 | 17p13.3-q11.1 | 0.02-25.61 | 8.16-14.05 | −0.99 | 10.36-12.8 | 2.44 |
| 49 | 18q11.2-q21.1 | 18.61-46.28 | 34.95-40.68 | −1.19 | 34.16-43.14 | 8.99 |
| 50 | 18q22.1-q23 | 60.4-77.63 | 74.45-76.84 | −1.53 | 60.4-77.63 | 17.23 |
| 51 | 19q13.2-q13.43 | 44.67-63.76 | 69.99-60.04 | −1.31 | 59.85-60.18 | 0.33 |
| 52 | 21p11.2-q11.2 | 9.96-13.43 | 9.96-10.08 | −1.24 | 9.96-13.43 | 3.47 |
| 53 | 21q22.2-q22.3 | 39.76-46.94 | 41.7-41.76* | −4.09 | 45.08-45.17 | 0.09 |
|  |  |  |  |  | 46.77-46.94 | 0.17 |
| 54 | 22q11.1-q13.2 | 14.49-39.46 | 22.7-22.7 | −1.32 | 20.64-39.46 | 18.83 |

| | Minimal Common Regions (MCRs) | | | | | MCR Recurrence | | | | |
|---|---|---|---|---|---|---|---|---|---|---|
| | | # Trspt | | # on U133A | | Gain/Loss | | Amp/Del | | |
| # | Max Min | K | P | Total | Sig. | % | T | C | T | C | Candidates |

| # | Max Min | K | P | Total | Sig. | % | T | C | T | C | Candidates |
|---|---|---|---|---|---|---|---|---|---|---|---|
| | | | | Gain and Amplification | | | | | | | |
| 1 | 1.55 | 23 | 47 | 15 | 2 | 23 | 2 | 6 | 2 | 2 | |
| 2 | 1.05 | 57 | 164 | 19 | 8 | 43 | 1 | 14 | 0 | 5 | |
| 3 | 0.97 | 0 | 0 | 1 | 0 | 14 | 1 | 4 | 1 | 1 | |
| 4 | 1.36 | 15 | 3 | 14 | 1 | 29 | 1 | 9 | 0 | 4 | NOTCH4 |
| 5 | 0.84 | 16 | 6 | 7 | 2 | 23 | 2 | 6 | 1 | 1 | |
| 6 | 0.93 | 45 | 53 | 10 | 6 | 51 | 4 | 14 | 0 | 7 | |
| 7 | 0.82 | 23 | 25 | 13 | 1 | 37 | 1 | 12 | 1 | 2 | |
| 8 | 1.06 | 12 | 22 | 7 | 5 | 34 | 1 | 11 | 1 | 1 | |
| 9 | 3.06 | 356 | 282 | 186 | 42 | 46 | 4 | 12 | 1 | 5 | |
| 10 | 1.71 | 31 | 14 | 14 | 8 | 37 | 1 | 12 | 0 | 2 | FGFRI |
|  | 1.44 | 3 | 4 | 5 | 0 | 31 | 1 | 10 | 0 | 2 | |
| 11 | 0.58 | 1 | 15 | 4 | 0 | 49 | 4 | 13 | 1 | 1 | |
| 12 | 1.78 | 317 | 461 | 115 | 41 | 66 | 6 | 17 | 0 | 7 | MYC |
| 13 | 0.86 | 39 | 23 | 18 | 9 | 20 | 1 | 6 | 0 | 3 | |
| 14 | 0.9 | 18 | 26 | 9 | 0 | 46 | 0 | 16 | 0 | 2 | |
| 15 | 2.52 | 9 | 5 | 3 | 1 | 26 | 2 | 7 | 2 | 2 | KRAS2 |
| 16 | 1.38 | 15 | 13 | 1 | 0 | 23 | 2 | 6 | 1 | 2 | |
| 17 | 0.89 | 43 | 74 | 19 | 3 | 20 | 2 | 5 | 1 | 2 | |
| 18 | 1.04 | 14 | 8 | 3 | 1 | 29 | 4 | 6 | 1 | 1 | |
| 19 | 0.98 | 36 | 61 | 14 | 7 | 34 | 4 | 8 | 1 | 2 | |
|  | 1.05 | 133 | 180 | 68 | 16 | 31 | 1 | 10 | 0 | 4 | |
| 20 | 2.37 | 474 | 308 | 215 | 70 | 46 | 2 | 14 | 0 | 7 | HER2 |
| 21 | 1.19 | 14 | 4 | 5 | 3 | 34 | 3 | 9 | 1 | 2 | |
| 22 | 2.12 | 26 | 37 | 11 | 6 | 29 | 4 | 6 | 3 | 3 | |
| 23 | 3.52 | 124 | 77 | 35 | 16 | 26 | 4 | 5 | 2 | 4 | OZF, AKT2 |
| 24 | 1.59 | 732 | 396 | 282 | 65 | 29 | 3 | 7 | 1 | 5 | |
| 25 | 1.26 | 26 | 31 | 10 | 1 | 40 | 3 | 11 | 1 | 6 | |
|  | 1.34 | 129 | 138 | 57 | 19 | 46 | 3 | 13 | 0 | 7 | AIB1, STK15 |
| 26 | 1.04 | 5 | 7 | 8 | 2 | 23 | 3 | 5 | 3 | 3 | |
| 27 | 0.93 | 12 | 7 | 5 | 2 | 26 | 3 | 6 | 1 | 1 | |
| | | | | Loss and Deletion | | | | | | | |
| 28 | −0.94 | 14 | 7 | 2 | 1 | 46 | 4 | 12 | 1 | 2 | |
|  | −0.73 | 151 | 67 | 64 | 18 | 49 | 3 | 14 | 1 | 1 | |
| 29 | −0.77 | 28 | 28 | 17 | 7 | 37 | 3 | 10 | 1 | 2 | |
|  | −0.87 | 28 | 29 | 10 | 4 | 37 | 3 | 10 | 1 | 2 | |
| 30 | −1.69 | 5 | 1 | 0 | 0 | 49 | 4 | 13 | 1 | 5 | |
| 31 | −0.85 | 0 | 0 | 1 | 1 | 26 | 4 | 6 | 2 | 1 | |
| 32 | −1.03 | 0 | 12 | 1 | 0 | 23 | 2 | 6 | 1 | 1 | |
| 33 | −1 | 13 | 15 | 6 | 3 | 34 | 4 | 8 | 0 | 2 | |
| 34 | −0.93 | 18 | 39 | 6 | 2 | 51 | 4 | 14 | 0 | 4 | |
|  | −0.91 | 24 | 40 | 14 | 0 | 51 | 4 | 14 | 1 | 4 | |
| 35 | −1.28 | 94 | 194 | 40 | 8 | 54 | 6 | 13 | 0 | 2 | |

TABLE 1-continued

List of High-Confidence MCRs.

| | | | | | | | | | | | |
|---|---|---|---|---|---|---|---|---|---|---|---|
| 36 | −1 | 7 | 24 | 3 | 1 | 20 | 1 | 6 | 1 | 1 | |
| 37 | −1.11 | 133 | 181 | 56 | 21 | 51 | 5 | 13 | 0 | 6 | |
| 38 | −0.91 | 98 | 144 | 38 | 8 | 46 | 5 | 11 | 1 | 4 | |
| 39 | −0.72 | 22 | 62 | 8 | 2 | 46 | 5 | 11 | 1 | 3 | |
| 40 | −1.31 | 27 | 57 | 12 | 4 | 54 | 2 | 17 | 0 | 11 | FEZ1 |
| | −0.95 | 60 | 131 | 28 | 16 | 46 | 1 | 15 | 0 | 11 | NRG1 |
| 41 | −1.38 | 15 | 38 | 8 | 3 | 60 | 8 | 13 | 2 | 9 | |
| | −2.63 | 129 | 216 | 55 | 15 | 57 | 7 | 13 | 1 | 11 | INK4A |
| 42 | −0.9 | 23 | 36 | 13 | 0 | 6 | 1 | 1 | 1 | 1 | |
| 43 | −0.73 | 123 | 129 | 68 | 18 | 29 | 2 | 8 | 1 | 1 | |
| 44 | −0.73 | 116 | 70 | 70 | 19 | 34 | 3 | 9 | 1 | 1 | |
| | −0.69 | 82 | 69 | 60 | 4 | 34 | 2 | 10 | 1 | 1 | |
| 45 | −0.8 | 57 | 96 | 34 | 13 | 31 | 3 | 8 | 1 | 1 | |
| 46 | −1.19 | 63 | 111 | 27 | 9 | 37 | 4 | 9 | 2 | 4 | DUSP6 |
| 47 | −0.67 | 34 | 17 | 15 | 7 | 29 | 1 | 9 | 1 | 2 | |
| 48 | −0.99 | 18 | 34 | 14 | 0 | 57 | 5 | 15 | 1 | 5 | TP53, MKK4 |
| 49 | −1.19 | 21 | 94 | 16 | 5 | 54 | 6 | 13 | 0 | 7 | |
| 50 | −1.53 | 98 | 287 | 23 | 8 | 60 | 7 | 14 | 0 | 7 | |
| 51 | −1.31 | 55 | 9 | 12 | 2 | 31 | 4 | 7 | 1 | 2 | |
| 52 | −1.24 | 2 | 8 | 3 | 0 | 60 | 5 | 16 | 1 | 2 | |
| 53 | −0.9 | 4 | 3 | 2 | 2 | 34 | 5 | 7 | 0 | 3 | |
| | −0.87 | 8 | 1 | 6 | 1 | 40 | 5 | 9 | 0 | 3 | |
| 54 | −1.32 | 424 | 350 | 243 | 65 | 54 | 5 | 14 | 0 | 7 | |

TABLE 2

List of cell lines and corresponding references used in this study

| Name | Source | Reference |
|---|---|---|
| PA-TU-8988T | DSMZ | Elsasser et al. Virchows Arch B Cell Pathol 61(5): 295-306. 1992 |
| PA-TU-8988S | DSMZ | Elsasser et al. Virchows Arch B Cell Pathol 61(5): 295-306. 1992 |
| PA-TU-8902 | DSMZ | Elsasser et al. Virchows Arch B Cell Pathol. 64: 201-207. 1993 |
| DAN-G | DSMZ | Not Published |
| HUP-T4 | DSMZ | Nishimura et al., Int. J. Pancreatol 13: 31-41. 1993 |
| HUP-T3 | DSMZ | Nishimura et al., Int. J. Pancreatol 13: 31-41. 1993 |
| Panc 10.05 | ATCC | Jaffee E M et al. Cancer J Sci Am 4: 194-203, 1998. |
| PL45 | ATCC | Jaffee E M et al. Cancer J Sci Am 4: 194-203, 1998. |
| Aspc-1 | ATCC | Chen et al. In Vitro. 1982 January; 18(1): 24-34. |
| Mpanc-96 | ATCC | Peiper M et al. Int. J. Cancer 71: 993-999, 1997. |
| BxPC-3 | ATCC | Tan M H et al. Cancer Invest. 4: 15-23, 1986. |
| Capan-1 | ATCC | Fogh et al. JNCI 58: 209-214. 1977 |
| Capan-2 | ATCC | Fogh et al. JNCI 58: 209-214. 1977 |
| CFPAC-1 | ATCC | Schoumacher et al. PNAS 87: 4012-4016. 1990 |
| HPAF-II | ATCC | Kim Y W et al. Pancreas 4: 353-362. 1989. |
| Hs766T | ATCC | Owens R. B. et al. JNCI 56: 843-849, 1976. |
| Panc-1 | ATCC | Lieber M et al. Int J. Cancer 15: 741-747. 1975 |
| SW1990 | ATCC | Kyriazis A P et al. Cancer Res. 43: 4393-4401. 1983 |
| MIA PaCa-2 | ATCC | Yunis A A et al. Int. J. Cancer 19: 128-135. 1977 |
| HPAC | ATCC | Gower W R et al. In vitro Cell Dev Biol. 30A: 151-161. 1994 |
| Panc 02.03 | ATCC | Jaffee E M et al. Cancer J Sci Am 4: 194-203, 1998. |
| Panc 02.13 | ATCC | Jaffee E M et al. Cancer J Sci Am 4: 194-203, 1998. |
| Panc 3.27 | ATCC | Jaffee E M et al. Cancer J Sci Am 4: 194-203, 1998. |
| Panc 08.13 | ATCC | Jaffee E M et al. Cancer J Sci Am 4: 194-203, 1998. |

TABLE 3

List of High and Moderal Confidence MCRs.

| | | Locus | Locus Peak Profile | | Minimal Common Regions (MCRs) | | | # Trspt | |
|---|---|---|---|---|---|---|---|---|---|
| # | Cytogenetic Band | Boundary (Mb) | Pos (MB) | Max/Min | Position (MB) | Size (MB) | Max Min | K | P |
| 1 | 1p13.1-p12 | 115.53-119.49 | 119.07-119.2 | 1.55 | 116.83-119.49 | 2.65 | 1.55 | 23 | 47 |
| 2 | 2p11.2-p11.1 | 85.23-91.48 | 85.78-85.78 | 1 | 85.75-85.85 | 0.1 | 1 | 10 | 5 |
| 3 | 3p11.1-q12.3 | 87.99-102.65 | 95.13-102.58 | 0.93 | 90.13-99.58 | 9.45 | 0.93 | 18 | 37 |
| | | | | | 101.35-101.83 | 0.48 | 0.93 | 5 | 7 |
| 4 | 5p15.33-p15.31 | 0.28-6.69 | 0.28-0.51 | 0.79 | 0.28-6.69 | 6.4 | 1.05 | 57 | 164 |

TABLE 3-continued

List of High and Moderal Confidence MCRs.

| | | | | | | | | | |
|---|---|---|---|---|---|---|---|---|---|
| 5 | 5q23.1-q31.1 | 115.81-132.47 | 131.44-132.27 | 1.08 | 115.81-132.47 | 16.66 | 1.08 | 110 | 182 |
| 6 | 5q31.1-q31.1 | 133.51-134.33 | 133.56-133.95 | 0.97 | 133.53-133.56 | 0.04 | 0.97 | 0 | 0 |
| 7 | 5q31.3-q31.3 | 139.21-140.22 | 139.48-140.22 | 0.65 | 139.21-140.04 | 0.83 | 0.65 | 39 | 16 |
| 9 | 8p22.1-p21.32 | 28.12-32.72 | 31.98-32.44 | 1.36 | 31.98-32.11 | 0.13 | 1.36 | 15 | 3 |
| | | | | | 32.19-32.21 | 0.02 | 1.36 | 0 | 0 |
| 10 | 8p21.1-p21.1 | 42.91-43.19 | 42.98-43.15 | 0.84 | 42.91-43.03 | 0.12 | 0.84 | 16 | 6 |
| 11 | 8q24.3-q25.1 | 145.88-151.63 | 150.09-151.19 | 1.45 | 150.09-151.12 | 1.03 | 1.45 | 16 | 32 |
| 12 | 7p22.3-p22.1 | 0.72-4.53 | 0.72-2.48 | 0.93 | 0.72-2.28 | 1.56 | 0.93 | 45 | 53 |
| 13 | 7p21.3-p21.2 | 7.39-14.44 | 7.97-14.44 | 0.58 | 7.39-14.44 | 7.04 | 0.8 | 20 | 58 |
| 14 | 7p15.1-p14.3 | 30.12-31.56 | 30.5-30.81 | 0.82 | 30.12-31.56 | 1.44 | 0.82 | 23 | 25 |
| 15 | 7p13-p11.2 | 44.93-54.88 | 43.64-47.71 | 1.23 | 44.93-54.88 | 9.95 | 1.23 | 41 | 143 |
| 16 | 7p11.21-q21.11 | 64.54-77.18 | 64.95-64.95 | 1.06 | 64.95-65.85 | 0.9 | 1.06 | 12 | 22 |
| 17 | 7q21.11-q32.2 | 79.45-129.46 | 97.86-98.55 | 3.06 | 92.33-112.27 | 19.94 | 3.06 | 356 | 282 |
| 18 | 7q34-q38.1 | 142.7-150.22 | 143.26-143.38 | 0.94 | 143.38-147.82 | 4.44 | 0.94 | 6 | 36 |
| 19 | 8p23.1-p22 | 8.75-12.74 | 11.05-11.57 | 2.05 | 8.76-12.74 | 3.98 | 2.05 | 43 | 74 |
| 20 | 8p12-p11.21 | 37.7-41.76 | 37.72-38.02 | 1.71 | 37.7-38.45 | 0.75 | 1.71 | 31 | 14 |
| | | | | | 38.68-39.52 | 0.84 | 1.44 | 3 | 4 |
| 21 | 8q12.1-q12.3 | 59.09-63.66 | 59.23-62.26 | 0.58 | 59.23-60.82 | 1.6 | 0.58 | 1 | 15 |
| 22 | 8q12.3-q13.1 | 63.7-67.06 | 65.44-66.81 | 0.87 | 63.7-67.06 | 3.37 | 0.87 | 20 | 43 |
| 23 | 8q21.3-q24.3 | 90.7-145.83 | 133.72-134.16 | 1.78 | 118.97-145.83 | 26.86 | 1.78 | 317 | 461 |
| 24 | 8p21.3-p13.2 | 23.68-37.87 | 35.65-36.56 | 0.86 | 35.8-36.56 | 0.96 | 0.86 | 39 | 23 |
| 25 | 10q25.2-q25.3 | 112.4-113.62 | 112.4-112.77 | 0.85 | 112.4-115.62 | 3.22 | 0.85 | 20 | 61 |
| 26 | 10q26.13-q28.2 | 124.92-129.83 | 126.14-126.14 | 0.65 | 124.92-126.41 | 1.49 | 0.65 | 9 | 30 |
| 27 | 11p12-p13.6 | 40.18-77.26 | 77-77.15 * | 0.9 | 60.11-61.14 | 1.03 | 0.81 | 32 | 19 |
| 28 | 11q14.1-q14.2 | 78.15-86.74 | 82.76-85.89 | 0.9 | 83.39-86.21 | 2.82 | 0.9 | 18 | 26 |
| 29 | 12p13.33-p13.2 | 0.18-11.45 | 0.18-2.79 | 1.77 | 0.18-0.74 | 0.56 | 1.77 | 10 | 6 |
| | | | | | 5.03-6.85 | 1.82 | 1.69 | 56 | 31 |
| | | | | | 7.05-7.18 | 0.13 | 0.84 | 5 | 3 |
| 30 | 12p13.2-p13.1 | 11.95-13.06 | 12.18-12.77 | 0.6 | 11.95-13.06 | 1.11 | 0.96 | 26 | 23 |
| 31 | 12p12.3-p13.13 | 16.6-53.06 | 20.7-22.54 | 2.52 | 21.82-22.39 | 0.57 | 2.52 | 9 | 5 |
| | | | | | 24.67-31.14 | 6.27 | 1.49 | 71 | 91 |
| 32 | 12q14.3-q14.3 | 64.61-66.08 | 65.95-68.08 | 0.93 | 64.61-66.08 | 1.46 | 0.93 | 9 | 19 |
| 33 | 12q15-q15 | 68.27-68.87 | 68.44-68.77 | 1.38 | 68.27-68.85 | 0.59 | 1.38 | 15 | 13 |
| 34 | 12p24.11-q24.12 | 108.06-110.72 | 108.55-110.68 | 0.98 | 108.06-110.72 | 2.66 | 0.98 | 59 | 37 |
| 35 | 12q24.31-q24.33 | 120.76-133.4 | 123.83-125.12 | 1.5 | 122.12-131.01 | 8.89 | 1.5 | 123 | 132 |
| 36 | 13q12.11-q14.15 | 18.68-43.95 | 19.21-24.22 | 0.89 | 18.68-19.21 | 0.53 | 0.89 | 6 | 6 |
| | | | | | 20.65-24.85 | 4.19 | 0.89 | 43 | 74 |
| 37 | 13q14.2-q14.2 | 45.56-47.81 | 47.45-47.77 | 0.56 | 45.64-47.81 | 2.18 | 0.63 | 12 | 29 |
| 38 | 13q34-q34 | 112.84-113.06 | 112.85-113.01 | 0.62 | 112.84-113.06 | 0.23 | 1.04 | 14 | 8 |
| 39 | 14q11.2-q24.3 | 18.82-74.47 | 73.56-74.47 * | 1.08 | 28.12-33.17 | 5.05 | 0.98 | 36 | 61 |
| | | | | | 48.08-51.17 | 3.09 | 0.74 | 61 | 40 |
| | | | | | 52.41-63.53 | 11.12 | 1.05 | 133 | 180 |
| 40 | 14q24.3-q32.11 | 75.23-88.86 | 75.25-86.96 | 0.93 | 75.23-87.87 | 12.63 | 0.93 | 65 | 138 |
| 41 | 14p32.12-q32.33 | 91.16-104.37 | 91.39-104.37 | 0.63 | 103.33-103.61 | 0.28 | 0.63 | 14 | 7 |
| 42 | 18p13.3-p13.3 | 0.03-4.95 | 3.37-3.49 | 1.23 | 1.81-1.95 | 0.15 | 0.85 | 7 | 5 |
| | | | | | 3.27-3.34 | 0.26 | 1.23 | 13 | 13 |
| | | | | | 3.9-4.52 | 0.62 | 0.94 | 11 | 18 |
| 43 | 16p13.3-p13.11 | 5.14-15.76 | 7.63-15.08 | 0.93 | 14.73-15.62 | 0.88 | 0.93 | 18 | 12 |
| 44 | 15p12.2-p12.1 | 23.7-27.3 | 24.03-25.16 * | 1.24 | 23.7-27.3 | 3.61 | 1.24 | 41 | 48 |
| 45 | 17q11.2-2q11.2 | 29.14-30.78 | 30.22-30.66 | 0.74 | 30.5-30.78 | 0.28 | 0.74 | 7 | 3 |
| 46 | 17q12-q23.2 | 37.48-56.39 | 43.53-43.53 | 2.37 | 38.95-55.26 | 16.31 | 2.37 | 474 | 308 |
| 47 | 17q23.2-q25.5 | 59.83-79.64 | 82.33-62.47 * | 3.61 | 74.02-74.22 | 0.2 | 1.19 | 14 | 4 |
| 48 | 18p11.21-q12.1 | 12.02-28.55 | 19.67-21.37 | 2.12 | 19.12-21.37 | 2.25 | 2.12 | 26 | 37 |
| 49 | 19p13.11-q13.32 | 23.32-50 | 45.03-45.39 * | 3.84 | 41.41-44.6 | 3.2 | 3.52 | 124 | 77 |
| 50 | 19q13.32-q13.43 | 50.06-63.76 | 50.85-50.65 | 1.59 | 50.06-62.89 | 12.83 | 1.59 | 732 | 396 |
| 51 | 20p13-q13.33 | 0.33-63.41 | 58.54-63.41 | 1.34 | 25.68-31.48 | 5.8 | 1.25 | 26 | 31 |
| | | | | | 50.87-55.58 | 4.71 | 1.18 | 15 | 69 |
| | | | | | 58.24-63.41 | 5.17 | 1.34 | 129 | 138 |
| 52 | 22q11.1-q12.1 | 14.65-26.58 | 22.7-22.7 | 1.04 | 22.64-22.83 | 0.2 | 1.04 | 5 | 7 |
| 53 | 22q12.2-q12.3 | 28.75-29.85 | 28.96-29.83 | 0.93 | 29.35-29.85 | 0.51 | 0.93 | 12 | 7 |
| 54 | 1p38.21-p36.11 | 15.02-26.95 | 21.46-21.46 | −0.94 | 21.08-21.56 | 0.48 | −0.94 | 14 | 7 |
| | | | | | 22.82-26.95 | 4.13 | −0.73 | 151 | 67 |
| 55 | 1p35.3-p34.3 | 28.37-39.18 | 32.79-33.04 * | −0.87 | 28.37-31.18 | 2.81 | −0.77 | 28 | 28 |
| | | | | | 32.67-34.68 | 2.01 | −0.87 | 28 | 29 |
| 56 | 1p34.2-p34.2 | 40.39-42.59 | 42.09-42.11 | −0.75 | 40.39-42.59 | 2.21 | −0.75 | 32 | 28 |
| 57 | 1p32.2-p31.3 | 56.74-60.95 | 56.77-59.75 | −0.59 | 56.74-60.95 | 4.21 | −0.67 | 17 | 46 |
| 58 | 1p21.2-p21.1 | 100.63-103.3 | 103.25-103.25 | 1.69 | 103.25-103.3 | 0.05 | −1.69 | 5 | 1 |
| 59 | 2p25.3-p24.3 | 0.21-16.09 | 10.92-11.3 * | −0.85 | 0.21-7.04 | 6.83 | −0.73 | 36 | 146 |
| | | | | | 11.3-11.32 | 0.02 | −0.85 | 0 | 0 |
| 60 | 2p12-p11.2 | 75.23-89 | 79.31-85.51 * | −1.03 | 77.7-79.27 | 1.57 | −1.03 | 0 | 12 |
| | | | | | 86.97-89 | 2.03 | −0.78 | 15 | 37 |
| 61 | 3p26.3-p24.3 | 1.33-18.8 | 13.65-14.52 | −1 | 11.29-12.18 | 0.89 | −0.78 | 8 | 6 |
| | | | | | 13.57-14.52 | 0.85 | −1 | 13 | 15 |
| 62 | 3p21.32-p14.1 | 44.51-66.3 | 53.69-57.41 | −0.87 | 53.08-61.58 | 8.51 | −0.87 | 68 | 122 |
| 63 | 4p16.3-p16.2 | 4.27-4.86 | 4.41-4.43 | −0.82 | 4.27-4.86 | 0.59 | −0.82 | 3 | 11 |
| 64 | 4p15.32-p15.2 | 17.28-26.18 | 24.69-26.12 | −0.94 | 17.28-26.18 | 8.91 | −0.94 | 49 | 107 |
| 65 | 4q13.2-q13.3 | 69.37-72.84 | 69.37-71.59 | −0.64 | 69.37-72.84 | 3.47 | −0.65 | 47 | 56 |
| 66 | 4q22.1-q22.1 | 88.79-89.29 | 89.13-89.13 | −0.75 | 88.79-89.29 | 0.5 | −0.75 | 5 | 8 |

TABLE 3-continued

List of High and Moderal Confidence MCRs.

| | | | | | | | | | |
|---|---|---|---|---|---|---|---|---|---|
| 67 | 4q24-q24 | 104.07-103.95 | 104.07-104.07 | −0.62 | 104.07-103.95 | −0.13 | −0.62 | 0 | 0 |
| 68 | 4q27-q28.1 | 123.22-129.09 | 123.77-124.24 | −0.75 | 123.22-129.09 | 5.87 | −0.75 | 27 | 49 |
| 69 | 4q31.22-q32.1 | 148.03-158.75 | 149.46-153.1 * | −0.93 | 151.71-154.37 | 2.65 | −0.93 | 18 | 39 |
| | | | | | 155.09-156.56 | 3.47 | −0.91 | 24 | 40 |
| 70 | 4q34.1-q35.2 | 174.84-188.09 | 175.03-187.79 | −1.28 | 174.84-188.09 | 13.26 | −1.28 | 94 | 194 |
| 71 | 5q23.2-q23.3 | 127.55-130.53 | 127.65-128.48 | −0.62 | 127.55-130.53 | 2.98 | −1 | 7 | 24 |
| 72 | 6p25.3-p12.2 | 0.4-52.14 | 0.4-2.83 | −1.17 | 0.4-2.83 | 2.42 | −1.17 | 14 | 50 |
| | | | | | 26.1-27.86 | 1.76 | −0.86 | 75 | 55 |
| 73 | 6p12.1-p12.1 | 56.4-57.04 | 56.4-56.4 | −0.64 | 56.4-57.04 | 0.64 | −0.72 | 10 | 7 |
| 74 | 6q21-q22.31 | 106.63-119.43 | 107.02-116.57 | −1.11 | 106.63-119.43 | 12.8 | −1.11 | 133 | 181 |
| 75 | 6q23.3-q24.3 | 135.17-146.81 | 137.46-138.13 | −0.91 | 135.17-146.81 | 11.64 | −0.91 | 98 | 144 |
| 76 | 6q26.3-q27 | 180.39-165.66 | 160.51-162.94 | −0.73 | 160.39-165.66 | 5.27 | −0.73 | 37 | 110 |
| 77 | 6q27-q27 | 168.07-170.54 | 168.63-170.54 | −0.72 | 168.07-170.54 | 2.47 | −0.72 | 22 | 82 |
| 78 | 7p21.2-p21.1 | 14.44-18.87 | 17.08-18.86 | −0.9 | 14.44-18.87 | 4.43 | −0.9 | 17 | 43 |
| 79 | 7q34-q36.1 | 142.47-147.82 | 143.2-143.38 | −0.8 | 142.7-147.82 | 5.12 | −0.8 | 17 | 83 |
| 80 | 8p23.3-p12 | 2.06-37.7 | 2.06-2.1 * | −1.85 | 18.07-21.75 | 3.68 | −1.31 | 27 | 87 |
| | | | | | 28.45-37.7 | 9.25 | −0.95 | 60 | 131 |
| 81 | 8p12-p11.21 | 37.7-42.45 | 38.45-42.33 | −1.19 | 37.7-39.05 | 1.35 | −1.19 | 41 | 21 |
| 82 | 9p24.3-p21.2 | 0.47-27.18 | 20.77-21.31 | −2.53 | 0.47-3.39 | 2.92 | −1.38 | 15 | 38 |
| | | | | | 5.3-23.68 | 18.39 | −2.53 | 129 | 215 |
| 83 | 9q13-q21.11 | 65.19-66.51 | 65.26-65.51 | −1.27 | 65.19-66.51 | 1.32 | −1.27 | 11 | 21 |
| 84 | 9q22.33-q31.1 | 97.63-101.94 | 97.64-101.81 | −0.81 | 97.63-101.94 | 4.31 | −0.81 | 31 | 44 |
| 85 | 9q31.2-q31.3 | 105.59-109.38 | 106.59-107.89 | −1 | 108.59-108.63 | 2.04 | −1 | 22 | 19 |
| 86 | 9q34.11-q34.11 | 127.73-128.53 | 127.75-127.81 | −0.91 | 127.73-128.53 | 0.8 | −0.91 | 17 | 9 |
| 87 | 10p15.3-p15.3 | 0.29-1.17 | 0.29-1.08 | −0.81 | 0.29-1.17 | 0.88 | −0.78 | 12 | 21 |
| 88 | 10p12.33-p12.1 | 17.91-26.66 | 18.09-18.32 | −3.3 | 17.91-26.66 | 8.75 | −3.3 | 48 | 110 |
| 89 | 10p12.1-p11.22 | 27.19-33.36 | 27.63-32.71 | −0.62 | 27.19-33.36 | 6.17 | −0.78 | 63 | 94 |
| 90 | 10q22.1-q22.1 | 73.46-73.72 | 73.46-73.47 | −3.23 | 73.46-73.72 | 0.26 | −3.23 | 2 | 4 |
| 91 | 10q22.3-q26.3 | 81.01-135.27 | 126.41-135.27 | −0.93 | 126.14-135.27 | 9.13 | −0.93 | 92 | 204 |
| 92 | 11p15.4-p15.3 | 10.84-13 | 12.02-12.02 | −3.72 | 10.84-13 | 2.16 | −3.72 | 24 | 35 |
| 93 | 11p15.2-p15.1 | 14.58-18.47 | 17.38-18.43 | −0.92 | 14.58-18.47 | 3.89 | −0.92 | 38 | 49 |
| 94 | 11p15.1-p13 | 20.11-32.17 | 20.42-31.85 | −1.2 | 20.11-32.17 | 12.05 | −1.2 | 80 | 100 |
| 95 | 11q14.1-q14.2 | 78.15-85.59 | 82.76-83.39 | −0.67 | 78.15-85.59 | 7.44 | −0.67 | 25 | 55 |
| 96 | 11q14.2-q14.3 | 85.89-89.24 | 86.21-89.24 | −0.9 | 85.89-59.24 | 3.35 | −0.9 | 23 | 36 |
| 97 | 11q21-q23.2 | 95.74-114.13 | 95.74-114.13 | −0.75 | 95.74-114.13 | 18.39 | −0.75 | 188 | 207 |
| 98 | 11q23.5-q25 | 116.73-134.28 | 117.1-134.27 | −0.7 | 120.33-121.54 | 1.21 | −0.7 | 10 | 19 |
| 99 | 12q12-q13.12 | 40.06-49.24 | 41.04-49.21 | −0.71 | 40.06-49.24 | 9.18 | −0.73 | 123 | 129 |
| 100 | 12q13.12-q13.3 | 49.65-55.82 | 50.01-53.06 | −0.7 | 49.65-53.06 | 3.41 | −0.73 | 118 | 70 |
| | | | | | 53.17-55.82 | 2.65 | −0.69 | 82 | 69 |
| 101 | 12q14.1-q15 | 57.92-68.77 | 62.76-68.27 | −0.8 | 62.76-68.77 | 6.01 | −0.8 | 57 | 96 |
| 102 | 12q21.2-q24.33 | 77.19-133.4 | 81.03-85.63 | −1.19 | 77.19-91.44 | 14.25 | −1.19 | 63 | 111 |
| 103 | 14q24.2-q24.3 | 71.68-72.03 | 71.72-71.73 | −1.1 | 71.68-72.03 | 0.35 | −1.1 | 5 | 6 |
| 104 | 16p13.3-p12.2 | 0.03-23.97 | 0.76-23.7 | −0.67 | 2.24-2.82 | 0.58 | −0.57 | 34 | 17 |
| 105 | 16q12.1-q12.2 | 48.37-55.26 | 50.08-53.88 | −1.1 | 48.37-53.88 | 5.52 | −1.1 | 35 | 83 |
| 106 | 17p13.3-q11.1 | 0.02-25.81 | 8.16-14.05 | −0.99 | 10.36-12.8 | 2.44 | −0.99 | 18 | 34 |
| 107 | 17q11.2-q11.2 | 26.68-30.22 | 26.68-28.65 | −0.83 | 27.8-28.97 | 1.17 | −0.83 | 17 | 12 |
| 108 | 17q24.2-q25.3 | 66.73-75.58 | 66.98-71.86 | −0.92 | 71.63-71.86 | 0.23 | −0.92 | 10 | 6 |
| 110 | 18q11.2-q21.1 | 18.51-48.28 | 34.95-40.58 | −1.19 | 34.16-43.14 | 8.99 | −1.19 | 21 | 94 |
| 111 | 18q22.1-q23 | 60.4-77.63 | 74.45-76.84 | −1.53 | 60.4-77.63 | 17.23 | −1.53 | 96 | 257 |
| 112 | 19p13.3-p13.2 | 4.62-9.11 | 6.63-6.68 | −0.86 | 6.61-6.85 | 0.24 | −0.88 | 11 | 4 |
| 113 | 19p13.2-p13.2 | 12.83-13.16 | 12.84-13.11 | −0.88 | 12.9-13.07 | 0.17 | −0.88 | 10 | 3 |
| 114 | 19q13.2-q13.43 | 44.57-63.76 | 59.99-60.04 | −1.31 | 50.65-51.57 | 0.92 | −0.68 | 40 | 29 |
| | | | | | 59.85-60.18 | 0.33 | −1.31 | 55 | 9 |
| 115 | 20p13-q11.21 | 0.33-30.89 | 8.81-25.63 | −1.39 | 5.91-25.68 | 19.77 | −1.39 | 139 | 321 |
| 116 | 21p11.2-q11.2 | 9.96-13.43 | 9.96-10.08 | −1.24 | 9.96-13.43 | 3.47 | −1.24 | 2 | 8 |
| 117 | 21q22.11-q22.11 | 31.95-32.5 | 32.16-32.5 | −1.15 | 31.95-32.5 | 0.55 | −1.10 | 3 | 8 |
| 118 | 21q22.11-q22.12 | 34.19-36.62 | 35.08-35.42 | −1.09 | 34.01-35.42 | 0.61 | −1.09 | 5 | 14 |
| 119 | 21q22.13-q22.13 | 37.01-37.52 | 37.01-37.02 | −1.58 | 37.01-37.52 | 0.5 | −1.58 | 9 | 10 |
| 120 | 21q22.2-q22.3 | 39.76-46.94 | 41.7-41.75 * | −4.09 | 45.08-45.17 | 0.09 | −0.9 | 4 | 3 |
| | | | | | 46.77-46.94 | 0.17 | −0.87 | 8 | 1 |
| 121 | 22q11.1-q13.2 | 14.49-39.46 | 22.7-22.7 | −1.32 | 20.64-39.46 | 18.83 | −1.32 | 424 | 350 |

| | Minimal Common Regions (MCRs) | | MCR Recurrence | | | | Affu | | | | |
| | # on U133A | | Gain/Loss | | Amp/Del | | genes | Affu | | | |
| # | Total | Sig. | % | T | C | T | C | signif | genes | ID | CNA | Bands |
|---|---|---|---|---|---|---|---|---|---|---|---|---|
| 1 | 15 | 2 | 23 | 2 | 6 | 2 | 2 | 2 | 15 | 29 | 1 | 1p13.1-1p12 |
| 2 | 7 | 2 | 14 | 0 | 5 | 0 | 2 | 2 | 7 | 2 | 2 | 2p11.2-2p11.1 |
| 3 | 5 | 0 | 29 | 1 | 9 | 0 | 2 | 0 | 5 | 31 | 3 | 3p11.1-3q12.3 |
| | 5 | 5 | 17 | 0 | 6 | 0 | 2 | 5 | 5 | 32 | 3 | 3p11.1-3q12.3 |
| 4 | 19 | 8 | 43 | 1 | 14 | 0 | 5 | 8 | 19 | 5 | 4 | 5p15.33-5p15. |
| 5 | 44 | 6 | 26 | 1 | 8 | 0 | 1 | 6 | 44 | 77 | 5 | 5q23.1-5q31.1 |
| 6 | 1 | 0 | 14 | 1 | 4 | 1 | 1 | 0 | 1 | 78 | 6 | 5q31.1-6q31.1 |
| 7 | 10 | 0 | 31 | 2 | 9 | 0 | 2 | 0 | 10 | 113 | 7 | 5q31.3-5q31.3 |

TABLE 3-continued

List of High and Moderal Confidence MCRs.

| | | | | | | | | | | | | |
|---|---|---|---|---|---|---|---|---|---|---|---|---|
| 9 | 14 | 1 | 29 | 1 | 9 | 0 | 4 | 1 | 14 | 34 | 8 | 8p22.1-6p21.3 |
| | 2 | 0 | 29 | 1 | 9 | 0 | 3 | 0 | 2 | 35 | 9 | 8p22.1-6p21.3 |
| 10 | 7 | 2 | 23 | 2 | 6 | 1 | 1 | 2 | 7 | 125 | 10 | 6p21.1-8p21.1 |
| 11 | 4 | 1 | 17 | 0 | 6 | 0 | 2 | 1 | 4 | 8 | 11 | 8q24.3-8q25.1 |
| 12 | 10 | 6 | 51 | 4 | 14 | 0 | 7 | 6 | 10 | 36 | 12 | 7p22.3-7p22.1 |
| 13 | 13 | 3 | 40 | 2 | 12 | 1 | 2 | 3 | 13 | 155 | 13 | 7p21.3-7p21.2 |
| 14 | 13 | 1 | 37 | 1 | 12 | 1 | 2 | 1 | 13 | 126 | 14 | 7p13.1-7p14.3 |
| 15 | 27 | 13 | 34 | 0 | 12 | 0 | 2 | 13 | 27 | 62 | 15 | 7p13-7p11.2 |
| 16 | 7 | 5 | 34 | 1 | 11 | 1 | 1 | 5 | 7 | 9 | 16 | 7q11.21-7q21. |
| 17 | 166 | 42 | 46 | 4 | 12 | 1 | 5 | 42 | 166 | 11 | 17 | 7q21.11-7q32. |
| 18 | 4 | 0 | 17 | 0 | 6 | 0 | 2 | 0 | 4 | 38 | 18 | 7q34-7q36.1 |
| 19 | 14 | 3 | 11 | 0 | 4 | 0 | 1 | 3 | 14 | 63 | 19 | 8p23.1-8p22 |
| 20 | 14 | 8 | 37 | 1 | 12 | 0 | 2 | 6 | 14 | 64 | 20 | 8p12-8p11.21 |
| | 5 | 0 | 31 | 1 | 10 | 0 | 2 | 0 | 5 | 65 | 20 | 8p12-8p11.21 |
| 21 | 4 | 0 | 49 | 4 | 13 | 1 | 1 | 0 | 4 | 96 | 21 | 8q12.1-8q12.3 |
| 22 | 6 | 0 | 43 | 3 | 12 | 0 | 1 | 0 | 6 | 127 | 22 | 8q12.3-8q13.1 |
| 23 | 115 | 41 | 56 | 6 | 17 | 0 | 7 | 41 | 115 | 13 | 23 | 8q21.3-8q24.3 |
| 24 | 18 | 9 | 20 | 1 | 6 | 0 | 3 | 9 | 18 | 14 | 24 | 9p21.3-9p13.2 |
| 25 | 15 | 3 | 26 | 2 | 7 | 0 | 1 | 3 | 15 | 15 | 25 | 10q25.2-10q2 |
| 26 | 7 | 0 | 23 | 1 | 7 | 0 | 2 | 0 | 7 | 74 | 26 | 10q26.13-10q2 |
| 27 | 13 | 0 | 40 | 1 | 13 | 0 | 3 | 0 | 13 | 16 | 27 | 11p12-11q13.5 |
| 28 | 9 | 0 | 46 | 0 | 16 | 0 | 2 | 0 | 9 | 87 | 28 | 11q14.1-11q14 |
| 29 | 4 | 1 | 23 | 2 | 6 | 0 | 2 | 1 | 4 | 99 | 29 | 12p13.33-12p3 |
| | 33 | 14 | 20 | 1 | 6 | 0 | 2 | 14 | 33 | 100 | 29 | 12p13.33-12p3 |
| | 2 | 1 | 20 | 1 | 6 | 0 | 2 | 1 | 2 | 101 | 29 | 12p13.33-12p3 |
| 30 | 14 | 8 | 26 | 3 | 6 | 0 | 2 | 8 | 14 | 68 | 30 | 12p13.2-12p13 |
| 31 | 3 | 1 | 26 | 2 | 7 | 2 | 2 | 1 | 3 | 40 | 31 | 12p12.3-12q13 |
| | 26 | 13 | 34 | 1 | 11 | 0 | 3 | 13 | 26 | 41 | 31 | 12p12.3-12q13 |
| 32 | 7 | 0 | 17 | 1 | 5 | 0 | 2 | 0 | 7 | 42 | 32 | 12q14.3-12q14 |
| 33 | 1 | 0 | 23 | 2 | 6 | 1 | 2 | 0 | 1 | 114 | 33 | 12q15-12q15 |
| 34 | 28 | 0 | 20 | 1 | 6 | 0 | 3 | 9 | 28 | 88 | 34 | 12q24.11-12q2 |
| 35 | 29 | 0 | 20 | 1 | 6 | 0 | 3 | 9 | 29 | 89 | 35 | 12q24.31-12q2 |
| 36 | 3 | 0 | 20 | 2 | 5 | 0 | 2 | 0 | 3 | 81 | 36 | 13q12.11-13q2 |
| | 19 | 3 | 20 | 2 | 5 | 1 | 2 | 3 | 19 | 82 | 36 | 13q12.11-13q2 |
| 37 | 12 | 4 | 26 | 4 | 5 | 1 | 2 | 4 | 12 | 90 | 37 | 13q14.2-13q14 |
| 38 | 3 | 1 | 29 | 4 | 6 | 1 | 1 | 1 | 3 | 67 | 38 | 13q34-13q34 |
| 39 | 14 | 7 | 34 | 4 | 8 | 1 | 2 | 7 | 14 | 18 | 39 | 14q11.2-14q24 |
| | 26 | 17 | 29 | 2 | 8 | 0 | 3 | 17 | 26 | 19 | 39 | 14q11.2-14q24 |
| | 68 | 16 | 31 | 1 | 10 | 0 | 4 | 16 | 68 | 20 | 39 | 14q11.2-14q24 |
| 40 | 29 | 9 | 17 | 0 | 6 | 0 | 2 | 9 | 29 | 75 | 40 | 14q24.3-14q32 |
| 41 | 7 | 4 | 23 | 3 | 5 | 0 | 3 | 4 | 7 | 43 | 41 | 14q32.12-14q3 |
| 42 | 4 | 2 | 11 | 1 | 3 | 0 | 2 | 2 | 4 | 21 | 42 | 16p13.3-16p13 |
| | 9 | 3 | 14 | 0 | 5 | 0 | 2 | 3 | 9 | 22 | 42 | 16p13.3-16p13 |
| | 6 | 2 | 14 | 0 | 5 | 0 | 2 | 2 | 6 | 23 | 42 | 16p13.3-16p13 |
| 43 | 5 | 2 | 20 | 1 | 6 | 0 | 2 | 2 | 5 | 24 | 43 | 16p13.3-16p13 |
| 44 | 0 | 4 | 26 | 2 | 7 | 1 | 0 | 4 | 9 | 148 | 44 | 16p12.2-16p12 |
| 45 | 1 | 0 | 26 | 3 | 6 | 1 | 1 | 0 | 1 | 142 | 45 | 17q11.2-17q12 |
| 46 | 215 | 70 | 46 | 2 | 14 | 0 | 7 | 70 | 215 | 27 | 46 | 17q12-17q23.2 |
| 47 | 5 | 3 | 34 | 3 | 9 | 1 | 2 | 3 | 5 | 92 | 47 | 17q23.2-17q25 |
| 48 | 11 | 6 | 29 | 4 | 6 | 3 | 3 | 6 | 11 | 140 | 48 | 18p11.21-18q |
| 49 | 35 | 16 | 26 | 4 | 5 | 2 | 4 | 18 | 35 | 45 | 49 | 19p13.11-19q |
| 50 | 282 | 65 | 29 | 3 | 7 | 1 | 5 | 65 | 282 | 46 | 50 | 19q13.32-19q |
| 51 | 10 | 1 | 40 | 3 | 11 | 1 | 5 | 1 | 10 | 47 | 51 | 20p13-20q13.3 |
| | 12 | 4 | 46 | 3 | 13 | 0 | 7 | 4 | 12 | 48 | 51 | 20p13-20q13.3 |
| | 57 | 19 | 46 | 3 | 13 | 0 | 7 | 19 | 57 | 49 | 51 | 20p13-20q13.3 |
| 52 | 6 | 2 | 23 | 3 | 5 | 3 | 3 | 2 | 6 | 83 | 52 | 22q11.1-22q12 |
| 53 | 5 | 2 | 26 | 3 | 6 | 1 | 1 | 2 | 5 | 115 | 53 | 22q12.2-22q12 |
| 54 | 2 | 1 | 46 | 4 | 12 | 2 | 2 | 1 | 2 | 236 | 54 | 1p36.21-1p36. |
| | 64 | 18 | 49 | 3 | 14 | 1 | 1 | 18 | 84 | 237 | 54 | 1p36.21-1p36. |
| 55 | 17 | 7 | 37 | 3 | 10 | 1 | 2 | 7 | 17 | 182 | 55 | 1p35.3-1p34.3 |
| | 10 | 4 | 37 | 3 | 10 | 1 | 2 | 4 | 10 | 183 | 55 | 1p35.3-1p34.3 |
| 56 | 14 | 4 | 29 | 3 | 7 | 0 | 0 | 4 | 14 | 283 | 56 | 1p34.2-1p34.2 |
| 57 | 7 | 2 | 37 | 3 | 10 | 1 | 2 | 2 | 7 | 252 | 57 | 1p32.2-1p31.3 |
| 58 | 0 | 0 | 49 | 4 | 13 | 1 | 5 | 0 | 0 | 238 | 58 | 1p21.2-1p21.1 |
| 59 | 14 | 6 | 34 | 3 | 9 | 1 | 3 | 6 | 14 | 161 | 59 | 2p25.3-2p24.3 |
| | 1 | 1 | 26 | 4 | 5 | 2 | 1 | 1 | 1 | 162 | 59 | 2p25.3-2p24.3 |
| 60 | 1 | 0 | 23 | 2 | 6 | 1 | 1 | 0 | 1 | 230 | 60 | 2p12-2p11.2 |
| | 10 | 0 | 11 | 1 | 3 | 1 | 1 | 0 | 10 | 231 | 60 | 2p12-2p11.2 |
| 61 | 5 | 2 | 34 | 5 | 7 | 1 | 1 | 2 | 5 | 163 | 61 | 3p26.3-3p24.3 |
| | 5 | 3 | 34 | 4 | 8 | 0 | 2 | 3 | 8 | 164 | 61 | 3p26.3-3p24.3 |
| 62 | 25 | 12 | 43 | 3 | 12 | 0 | 4 | 12 | 28 | 233 | 62 | 3p21.32-3p14 |
| 63 | 2 | 1 | 37 | 4 | 0 | 0 | 2 | 1 | 2 | 185 | 63 | 4p16.3-4p16.2 |
| 64 | 15 | 5 | 40 | 4 | 10 | 0 | 4 | 5 | 15 | 239 | 64 | 4p15.32-4p15 |
| 65 | 28 | 4 | 51 | 4 | 14 | 0 | 2 | 4 | 28 | 265 | 65 | 4q13.2-4q13.3 |
| 66 | 6 | 0 | 48 | 3 | 13 | 0 | 2 | 0 | 8 | 218 | 66 | 4q22.1-4q22.1 |
| 67 | 0 | 0 | 43 | 2 | 13 | 0 | 2 | 0 | 0 | 219 | 67 | 4q24-4q24 |
| 68 | 9 | 2 | 48 | 3 | 13 | 0 | 2 | 2 | 9 | 165 | 68 | 4q27-4q28.1 |

TABLE 3-continued

List of High and Moderal Confidence MCRs.

| | | | | | | | | | | | | |
|---|---|---|---|---|---|---|---|---|---|---|---|---|
| 69 | 8 | 2 | 51 | 4 | 14 | 0 | 4 | 2 | 6 | 167 | 69 | 4q31.22-4q32. |
| | 14 | 0 | 51 | 4 | 14 | 1 | 4 | 0 | 14 | 168 | 69 | 4q31.22-4q32. |
| 70 | 40 | 8 | 54 | 5 | 13 | 0 | 2 | 8 | 40 | 210 | 70 | 4q34.1-4q35.2 |
| 71 | 3 | 1 | 20 | 1 | 8 | 1 | 1 | 1 | 3 | 281 | 71 | 5q23.2-5q23.3 |
| 72 | 7 | 1 | 40 | 6 | 5 | 0 | 4 | 1 | 7 | 184 | 72 | 6p25.3-5p12.2 |
| | 56 | 7 | 29 | 4 | 5 | 0 | 3 | 7 | 56 | 185 | 72 | 6p25.3-6p12.2 |
| 73 | 6 | 1 | 34 | 5 | 7 | 1 | 3 | 1 | 5 | 279 | 73 | 6p12.1-6p12.1 |
| 74 | 66 | 21 | 51 | 6 | 13 | 0 | 6 | 21 | 56 | 187 | 74 | 6q21-6q22.31 |
| 75 | 38 | 8 | 48 | 5 | 11 | 1 | 4 | 5 | 38 | 241 | 75 | 6q23.3-6q24.3 |
| 76 | 18 | 6 | 48 | 5 | 11 | 0 | 5 | 8 | 18 | 188 | 76 | 6q25.3-6q27 |
| 77 | 4 | 2 | 48 | 5 | 11 | 1 | 3 | 2 | 8 | 282 | 77 | 6q27-6q27 |
| 78 | 13 | 1 | 9 | 1 | 2 | 1 | 0 | 1 | 13 | 295 | 78 | 7p21.2-7p21.1 |
| 79 | 12 | 0 | 31 | 3 | 8 | 2 | 2 | 0 | 12 | 265 | 79 | 7q34-7q36.1 |
| 80 | 12 | 4 | 54 | 2 | 17 | 0 | 11 | 4 | 12 | 190 | 80 | 8p23.3-8p12 |
| | 28 | 16 | 48 | 1 | 15 | 0 | 11 | 18 | 28 | 191 | 80 | 8p23.3-8p12 |
| 81 | 17 | 3 | 37 | 1 | 12 | 0 | 5 | 3 | 17 | 212 | 81 | 8p12-8p11.21 |
| 82 | 8 | 3 | 60 | 6 | 13 | 2 | 9 | 3 | 8 | 170 | 82 | 9p24.3-9p21.2 |
| | 55 | 15 | 57 | 7 | 13 | 1 | 11 | 18 | 65 | 171 | 82 | 9p24.3-9q21.2 |
| 83 | 0 | 0 | 40 | 5 | 9 | 0 | 2 | 0 | 0 | 272 | 83 | 9q13-9q21.11 |
| 84 | 13 | 2 | 14 | 2 | 3 | 1 | 0 | 2 | 13 | 297 | 84 | 9q22.33-9q31. |
| 85 | 13 | 8 | 14 | 1 | 4 | 0 | 2 | 8 | 13 | 250 | 85 | 9q31.2-9q31.3 |
| 86 | 10 | 5 | 14 | 2 | 3 | 1 | 0 | 5 | 10 | 285 | 86 | 9q34.11-9q34 |
| 87 | 7 | 3 | 40 | 3 | 11 | 1 | 4 | 3 | 7 | 258 | 87 | 10p15.3-10p15 |
| 88 | 24 | 4 | 57 | 1 | 12 | 0 | 5 | 4 | 24 | 173 | 88 | 10p12.33-10p |
| 89 | 20 | 9 | 34 | 2 | 10 | 1 | 4 | 9 | 20 | 298 | 89 | 10p12.1-10p |
| 90 | 1 | 0 | 17 | 1 | 5 | 0 | 2 | 0 | 1 | 174 | 90 | 10q22.1-10q22 |
| 91 | 34 | 16 | 26 | 2 | 7 | 0 | 2 | 15 | 34 | 221 | 91 | 10q22.3-10q26 |
| 92 | 10 | 4 | 25 | 1 | 5 | 0 | 2 | 4 | 10 | 175 | 92 | 11p15.4-11p15 |
| 93 | 27 | 4 | 29 | 1 | 9 | 0 | 3 | 4 | 27 | 195 | 93 | 11p15.2-11p15 |
| 94 | 23 | 7 | 28 | 1 | 8 | 0 | 2 | 7 | 23 | 198 | 94 | 11p15.1-11p13 |
| 95 | 11 | 0 | 8 | 1 | 1 | 1 | 1 | 0 | 11 | 204 | 95 | 11q14.1-11q14 |
| 96 | 13 | 0 | 8 | 1 | 1 | 1 | 1 | 0 | 13 | 222 | 96 | 11q14.2-11q14 |
| 97 | 75 | 8 | 17 | 2 | 4 | 1 | 1 | 8 | 75 | 223 | 97 | 11q21-11q23.2 |
| 98 | 4 | 1 | 11 | 1 | 3 | 1 | 2 | 1 | 4 | 178 | 98 | 11q23.3-11q25 |
| 99 | 58 | 18 | 29 | 2 | 8 | 1 | 1 | 18 | 55 | 290 | 99 | 12q12-12q13. |
| 100 | 70 | 19 | 34 | 3 | 9 | 1 | 1 | 19 | 70 | 291 | 100 | 12q13.12-12q |
| | 60 | 4 | 34 | 2 | 10 | 1 | 1 | 4 | 80 | 292 | 100 | 12q13.12-12q |
| 101 | 34 | 13 | 31 | 3 | 8 | 1 | 1 | 13 | 34 | 293 | 101 | 12q14.1-12q15 |
| 102 | 27 | 9 | 37 | 4 | 9 | 2 | 4 | 9 | 27 | 197 | 102 | 12q21.2-12q2 |
| 103 | 2 | 1 | 17 | 2 | 4 | 1 | 0 | 1 | 2 | 294 | 103 | 14q24.2-14q2 |
| 104 | 15 | 7 | 29 | 1 | 9 | 1 | 2 | 7 | 15 | 242 | 104 | 16p13.3-16p12 |
| 105 | 24 | 6 | 11 | 1 | 3 | 0 | 2 | 8 | 24 | 192 | 105 | 16q12.1-16q12 |
| 106 | 14 | 0 | 57 | 5 | 15 | 1 | 5 | 0 | 14 | 178 | 106 | 17p13.3-17q1 |
| 107 | 5 | 1 | 26 | 3 | 6 | 0 | 2 | 1 | 5 | 225 | 107 | 17q11.2-17q1 |
| 108 | 2 | 0 | 23 | 2 | 6 | 0 | 3 | 0 | 2 | 228 | 108 | 17p24.2-17q25 |
| 110 | 16 | 5 | 54 | 6 | 13 | 0 | 7 | 5 | 16 | 208 | 110 | 18q11.2-18q2 |
| 111 | 23 | 8 | 50 | 7 | 14 | 0 | 7 | 8 | 23 | 213 | 111 | 18q22.1-18q23 |
| 112 | 5 | 2 | 31 | 2 | 9 | 0 | 2 | 2 | 6 | 196 | 112 | 19p13.3-19p13 |
| 113 | 4 | 3 | 29 | 2 | 8 | 0 | 2 | 3 | 4 | 158 | 113 | 19p13.2-19p13 |
| 114 | 21 | 12 | 34 | 4 | 8 | 1 | 2 | 12 | 21 | 159 | 114 | 19q13.2-19q13 |
| | 12 | 2 | 31 | 4 | 7 | 1 | 2 | 2 | 12 | 150 | 114 | 19q13.2-19q13 |
| 115 | 76 | 27 | 34 | 2 | 10 | 0 | 6 | 27 | 75 | 194 | 115 | 20p13-20q11.3 |
| 116 | 3 | 0 | 60 | 5 | 18 | 1 | 2 | 0 | 3 | 200 | 116 | 21p11.2-21q1 |
| 117 | 5 | 0 | 34 | 3 | 9 | 0 | 2 | 0 | 3 | 208 | 117 | 21q22.11-21q3 |
| 118 | 4 | 0 | 40 | 4 | 10 | 0 | 3 | 0 | 4 | 214 | 118 | 21q22.11-21q3 |
| 119 | 5 | 2 | 37 | 4 | 9 | 0 | 1 | 2 | 5 | 215 | 119 | 21q22.15-21q3 |
| 120 | 2 | 2 | 34 | 5 | 7 | 0 | 3 | 2 | 2 | 243 | 120 | 21q22.2-21q23 |
| | 6 | 1 | 40 | 5 | 9 | 0 | 3 | 1 | 6 | 244 | 120 | 21q22.2-21q23 |
| 121 | 243 | 85 | 54 | 5 | 14 | 0 | 7 | 65 | 243 | 179 | 121 | 22q11.1-22q13 |

| # | | Locus | Max.Min | Max:Min.Val | MCR.Loc | MCR.Size |
|---|---|---|---|---|---|---|
| 1 | TRUE | 116.83-119.49 | 119.07-119.2 | 1.55 | 118.83-119.49 | 2.65 |
| 2 | TRUE | 85.23-91.48 | 95.78-85.78 | 1 | 85.75-85.85 | 0.1 |
| 3 | TRUE | 87.99-102.65 | 95.13-102.58 | 0.93 | 90.13-99.58 | 9.45 |
| | FALSE | 87.99-102.65 | 95.13-102.58 | 0.93 | 101.35-101.83 | 0.48 |
| 4 | TRUE | 0.28-6.69 | 0.28-0.51 | 0.79 | 0.28-6.69 | 6.4 |
| 5 | TRUE | 115.81-132.47 | 131.44-132.27 | 1.08 | 115.81-132.47 | 16.66 |
| 6 | TRUE | 133.51-134.33 | 133.56-133.95 | 0.97 | 133.53-133.56 | 0.04 |
| 7 | TRUE | 139.21-140.22 | 139.48-140.22 | 0.65 | 139.21-140.04 | 0.83 |
| 9 | TRUE | 28.12-32.72 | 31.98-32.44 | 1.36 | 31.98-32.11 | 0.13 |
| | FALSE | 28.12-32.72 | 31.98-32.44 | 1.36 | 32.19-32.21 | 0.02 |
| 10 | TRUE | 42.91-43.19 | 42.98-43.15 | 0.84 | 42.91-43.03 | 0.12 |
| 11 | TRUE | 145.88-131.63 | 150.09-151.19 | 1.45 | 150.09-151.12 | 1.03 |
| 12 | TRUE | 0.72-4.53 | 0.72-2.48 | 0.93 | 0.72-2.28 | 1.56 |
| 13 | TRUE | 7.39-14.44 | 7.97-14.44 | 0.58 | 7.39-14.44 | 7.04 |
| 14 | TRUE | 30.12-31.56 | 30.5-30.81 | 0.82 | 30.12-31.56 | 1.44 |
| 15 | TRUE | 44.93-54.88 | 45.64-47.71 | 1.23 | 44.93-54.88 | 9.95 |

TABLE 3-continued

List of High and Moderal Confidence MCRs.

| | | | | | | |
|---|---|---|---|---|---|---|
| 16 | TRUE | 64.84-77.16 | 64.95-84.95 | 1.06 | 64.95-65.85 | 0.9 |
| 17 | TRUE | 79.45-129.46 | 97.86-98.55 | 3.06 | 92.33-112.27 | 19.94 |
| 18 | TRUE | 142.7-150.22 | 143.26-143.38 | 0.94 | 143.38-147.82 | 4.44 |
| 19 | TRUE | 8.76-12.74 | 11.05-11.57 | 2.05 | 8.76-12.74 | 3.98 |
| 20 | TRUE | 37.7-41.76 | 37.72-38.02 | 1.71 | 37.7-38.45 | 0.75 |
| | FALSE | 37.7-41.76 | 37.72-38.02 | 1.71 | 38.68-39.52 | 0.84 |
| 21 | TRUE | 59.09-63.66 | 50.23-62.26 | 0.58 | 59.23-60.82 | 1.6 |
| 22 | TRUE | 63.7-67.06 | 65.44-66.81 | 0.87 | 63.7-67.06 | 3.37 |
| 23 | TRUE | 90.7-145.83 | 133.72-134.16 | 1.78 | 118.97-145.83 | 26.86 |
| 24 | TRUE | 23.68-37.87 | 35.65-36.56 | 0.86 | 35.6-36.56 | 0.96 |
| 25 | TRUE | 112.4-115.62 | 112.4-112.77 | 0.85 | 112.4-115.62 | 3.22 |
| 26 | TRUE | 124.92-129.83 | 126.14-126.14 | 0.65 | 124.92-126.41 | 1.49 |
| 27 | TRUE | 40.18-77.26 | 77-77.15 | 0.9 | 60.11-31.14 | 1.03 |
| 28 | TRUE | 78.15-86.74 | 82.76-85.89 | 0.9 | 83.39-86.21 | 2.82 |
| 29 | TRUE | 0.18-11.45 | 0.18-2.79 | 1.77 | 0.18-0.74 | 0.56 |
| | FALSE | 0.18-11.45 | 0.18-2.79 | 1.77 | 5.03-6.85 | 1.82 |
| | FALSE | 0.18-11.45 | 0.18-2.79 | 1.77 | 7.05-7.18 | 0.13 |
| 30 | TRUE | 11.95-13.06 | 12.18-12.77 | 0.6 | 11.95-13.06 | 1.11 |
| 31 | TRUE | 16.6-53.06 | 20.7-22.54 | 2.52 | 21.82-22.39 | 0.57 |
| | FALSE | 16.6-53.06 | 20.7-22.54 | 2.52 | 24.87-31.14 | 6.27 |
| 32 | TRUE | 64.61-66.08 | 65.95-66.06 | 0.93 | 64.61-66.08 | 1.46 |
| 33 | TRUE | 68.27-68.87 | 68.44-68.77 | 1.38 | 68.27-68.85 | 0.59 |
| 34 | TRUE | 108.06-110.72 | 108.55-110.68 | 0.98 | 108.06-110.72 | 2.66 |
| 35 | TRUE | 120.76-133.4 | 123.83-125.12 | 1.5 | 122.12-131.01 | 8.89 |
| 36 | TRUE | 18.68-43.95 | 19.21-24.22 | 0.89 | 18.68-19.21 | 0.53 |
| | FALSE | 18.68-43.95 | 19.21-24.22 | 0.89 | 20.65-24.85 | 4.19 |
| 37 | TRUE | 47.56-47.81 | 47.45-47.77 | 0.58 | 45.64-47.81 | 2.18 |
| 38 | TRUE | 112.84-113.06 | 112.85-113.01 | 0.62 | 112.84-113.06 | 0.23 |
| 39 | TRUE | 18.82-74.47 | 73.56-74.47 | 1.08 | 28.12-33.17 | 5.05 |
| | FALSE | 18.82-74.47 | 73.56-74.47 | 1.08 | 48.08-51.17 | 3.09 |
| | FALSE | 18.82-74.47 | 73.56-74.47 | 1.08 | 52.41-63.53 | 11.12 |
| 40 | TRUE | 75.23-88.86 | 75.25-86.96 | 0.93 | 75.23-87.87 | 12.63 |
| 41 | TRUE | 91.16-104.37 | 91.39-104.37 | 0.63 | 103.33-103.61 | 0.28 |
| 42 | TRUE | 0.03-4.95 | 3.37-3.49 | 1.23 | 1.81-1.95 | 0.15 |
| | FALSE | 0.03-4.95 | 3.37-3.49 | 1.23 | 3.27-3.84 | 0.26 |
| | FALSE | 0.03-4.95 | 3.37-3.49 | 1.23 | 3.9-4.52 | 0.62 |
| 43 | TRUE | 5.14-15.76 | 7.63-15.08 | 0.93 | 14.73-15.62 | 0.88 |
| 44 | TRUE | 23.7-27.3 | 24.03-25.16 | 1.24 | 23.7-27.3 | 3.61 |
| 45 | TRUE | 29.14-30.78 | 30.32-30.66 | 0.74 | 30.5-30.78 | 0.28 |
| 46 | TRUE | 37.48-56.39 | 43.53-43.53 | 2.87 | 38.95-55.26 | 16.31 |
| 47 | TRUE | 59.83-79.64 | 62.33-62.47 | 3.61 | 74.02-74.22 | 0.2 |
| 48 | TRUE | 12.02-28.55 | 19.67-21.37 | 2.12 | 19.12-21.37 | 2.25 |
| 49 | TRUE | 23.32-50 | 45.03-45.39 | 3.84 | 41.41-44.6 | 3.2 |
| 50 | TRUE | 50.06-63.76 | 50.65-50.65 | 1.59 | 50.06-62.89 | 12.83 |
| 51 | TRUE | 0.33-63.41 | 58.54-63.41 | 1.34 | 25.68-31.48 | 5.8 |
| | FALSE | 0.33-63.41 | 58.54-63.41 | 1.34 | 50.87-55.58 | 4.71 |
| | FALSE | 0.33-63.41 | 58.54-63.41 | 1.34 | 58.24-63.41 | 5.17 |
| 52 | TRUE | 14.65-28.58 | 22.7-22.7 | 1.04 | 22.64-22.83 | 0.2 |
| 53 | TRUE | 28.75-29.85 | 28.96-29.83 | 0.93 | 29.35-29.85 | 0.51 |
| 54 | TRUE | 15.02-26.96 | 21.46-21.46 | −0.94 | 21.08-21.56 | 0.48 |
| | FALSE | 15.02-26.95 | 21.46-21.46 | −0.94 | 22.82-26.95 | 4.13 |
| 55 | TRUE | 28.37-39.18 | 32.79-33.04 | −0.87 | 28.37-31.18 | 2.81 |
| | FALSE | 28.37-39.18 | 32.79-33.04 | −0.87 | 32.67-34.68 | 2.01 |
| 56 | TRUE | 40.39-42.59 | 42.09-42.11 | −0.75 | 40.39-42.59 | 2.21 |
| 57 | TRUE | 56.74-60.95 | 56.77-59.75 | −0.59 | 56.74-60.95 | 4.21 |
| 58 | TRUE | 100.63-103.3 | 103.25-103.25 | −1.69 | 103.25-103.3 | 0.05 |
| 59 | TRUE | 0.21-16.09 | 10.92-11.3 | −0.65 | 0.21-7.04 | 6.83 |
| | FALSE | 0.21-16.09 | 10.92-11.3 | −0.85 | 11.3-11.32 | 0.02 |
| 60 | TRUE | 75.23-89 | 79.31-85.51 | −1.03 | 77.7-79.27 | 1.57 |
| | FALSE | 75.23-89 | 79.31-85.51 | −1.03 | 86.97-89 | 2.03 |
| 61 | TRUE | 1.33-18.8 | 13.85-14.52 | −1 | 11.29-12.18 | 0.89 |
| | FALSE | 1.33-18.8 | 13.65-14.52 | −1 | 13.67-14.52 | 0.85 |
| 62 | TRUE | 44.51-66.3 | 53.69-57.41 | −0.87 | 53.08-61.58 | 8.51 |
| 63 | TRUE | 4.27-4.86 | 4.41-4.43 | −0.82 | 4.27-4.86 | 0.59 |
| 64 | TRUE | 17.28-25.18 | 24.69-26.12 | −0.94 | 17.28-26.18 | 8.91 |
| 65 | TRUE | 69.37-72.84 | 69.37-71.59 | −0.64 | 69.37-72.84 | 3.47 |
| 66 | TRUE | 88.79-89.29 | 89.13-89.13 | −0.75 | 88.79-89.29 | 0.5 |
| 67 | TRUE | 104.07-103.95 | 104.07-104.07 | −0.62 | 104.07-103.95 | −0.13 |
| 68 | TRUE | 123.22-129.09 | 123.77-124.24 | −0.75 | 123.22-129.09 | 5.87 |
| 69 | TRUE | 148.03-158.75 | 149.46-153.1 | −0.93 | 151.71-154.37 | 2.65 |
| | FALSE | 148.03-158.75 | 149.46-153.1 | −0.93 | 155.09-158.56 | 3.47 |
| 70 | TRUE | 174.84-188.09 | 175.03-187.79 | −1.28 | 174.84-188.09 | 13.26 |
| 71 | TRUE | 127.55-130.53 | 127.65-128.48 | −0.62 | 127.55-130.53 | 2.98 |
| 72 | TRUE | 0.4-52.14 | 0.4-2.83 | −1.17 | 0.4-2.83 | 2.42 |
| | FALSE | 0.4-52.14 | 0.4-2.83 | −1.17 | 25.1-27.86 | 1.76 |
| 73 | TRUE | 56.4-57.04 | 56.4-56.4 | −0.64 | 58.4-57.04 | 0.64 |
| 74 | TRUE | 106.63-119.43 | 107.02-116.57 | −1.11 | 106.83-119.43 | 12.8 |
| 75 | TRUE | 135.17-146.81 | 137.46-138.13 | −0.91 | 135.17-146.81 | 11.64 |

TABLE 3-continued

List of High and Moderal Confidence MCRs.

| | | | | | | |
|---|---|---|---|---|---|---|
| 76 | TRUE | 160.39-165.66 | 160.51-162.94 | −0.73 | 160.39-165.66 | 5.27 |
| 77 | TRUE | 158.07-170.54 | 168.63-170.54 | −0.72 | 168.07-170.54 | 2.47 |
| 78 | TRUE | 14.44-18.87 | 17.08-18.86 | −0.9 | 14.44-18.87 | 4.43 |
| 79 | TRUE | 142.47-147.82 | 143.2-143.36 | −0.8 | 142.7-147.82 | 5.12 |
| 80 | TRUE | 2.06-37.7 | 2.06-2.1 | −1.86 | 18.07-21.75 | 3.68 |
| | FALSE | 2.06-17.7 | 2.06-2.1 | −1.86 | 28.45-37.7 | 9.25 |
| 81 | TRUE | 37.7-42.45 | 38.45-42.33 | −1.19 | 37.7-39.05 | 1.35 |
| 82 | TRUE | 0.47-27.18 | 20.77-21.31 | −2.53 | 0.47-3.39 | 2.92 |
| | FALSE | 0.47-27.18 | 20.77-21.31 | −2.53 | 5.3-23.68 | 18.39 |
| 83 | TRUE | 65.19-66.51 | 65.26-65.51 | −1.27 | 65.19-66.51 | 1.32 |
| 84 | TRUE | 97.63-101.94 | 97.64-101.81 | −0.81 | 97.63-101.94 | 4.31 |
| 85 | TRUE | 105.59-109.38 | 106.59-107.89 | −1 | 106.59-106.63 | 2.04 |
| 86 | TRUE | 127.73-128.53 | 127.75-127.81 | −0.91 | 127.73-128.53 | 0.8 |
| 87 | TRUE | 0.29-1.17 | 0.29-1.08 | −0.61 | 0.29-1.17 | 0.88 |
| 88 | TRUE | 17.91-26.66 | 18.09-18.32 | −3.3 | 17.91-26.66 | 8.75 |
| 89 | TRUE | 27.19-33.36 | 27.63-32.71 | −0.62 | 27.19-33.36 | 6.17 |
| 90 | TRUE | 73.46-73.72 | 73.46-73.47 | −3.23 | 73.46-73.72 | 0.26 |
| 91 | TRUE | 81.01-135.27 | 126.41-135.27 | −0.93 | 126.14-135.27 | 9.13 |
| 92 | TRUE | 10.84-13 | 12.02-12.02 | −3.72 | 10.84-13 | 2.16 |
| 93 | TRUE | 14.58-18.47 | 17.38-18.43 | −0.92 | 14.58-18.47 | 3.89 |
| 94 | TRUE | 20.11-32.17 | 20.42-31.85 | −1.2 | 20.11-32.17 | 12.05 |
| 95 | TRUE | 78.15-85.59 | 82.76-83.39 | −0.67 | 78.15-85.59 | 7.44 |
| 96 | TRUE | 85.89-89.24 | 86.21-89.24 | −0.9 | 85.89-89.24 | 3.35 |
| 97 | TRUE | 95.74-114.13 | 95.74-114.13 | −0.75 | 95.74-114.13 | 18.39 |
| 98 | TRUE | 116.73-134.28 | 117.1-134.27 | −0.7 | 120.33-121.54 | 1.21 |
| 99 | TRUE | 40.06-49.24 | 41.04-49.21 | −0.71 | 40.06-49.24 | 9.18 |
| 100 | TRUE | 49.55-55.82 | 50.01-53.06 | −0.7 | 49.65-53.06 | 3.41 |
| | FALSE | 49.55-55.82 | 50.01-53.06 | −0.7 | 53.17-55.82 | 2.65 |
| 101 | TRUE | 57.92-68.77 | 62.76-68.27 | −0.8 | 62.76-68.77 | 6.01 |
| 102 | TRUE | 77.19-133.4 | 81.03-85.63 | −1.19 | 77.19-91.44 | 14.25 |
| 103 | TRUE | 71.68-72.03 | 71.72-71.73 | −1.1 | 71.68-72.03 | 0.35 |
| 104 | TRUE | 0.03-23.97 | 0.76-23.7 | −0.67 | 2.24-2.82 | 0.58 |
| 105 | TRUE | 48.37-55.26 | 50.08-53.88 | −1.1 | 48.37-53.88 | 5.52 |
| 106 | TRUE | 0.02-25.81 | 8.16-14.05 | −0.99 | 10.36-12.8 | 2.44 |
| 107 | TRUE | 25.68-30.32 | 26.68-28.65 | −0.83 | 27.8-28.97 | 1.17 |
| 108 | TRUE | 66.73-76.58 | 66.96-71.86 | −0.92 | 71.63-71.86 | 0.23 |
| 110 | TRUE | 18.51-46.28 | 34.95-40.58 | −1.19 | 34.18-43.14 | 8.99 |
| 111 | TRUE | 60.4-77.63 | 74.45-76.84 | −1.53 | 60.4-77.63 | 17.23 |
| 112 | TRUE | 4.62-9.11 | 6.63-6.68 | −0.86 | 6.61-6.85 | 0.24 |
| 113 | TRUE | 12.83-13.18 | 12.84-13.11 | −0.88 | 12.9-13.07 | 0.17 |
| 114 | TRUE | 44.57-63.76 | 59.99-60.04 | −1.31 | 50.65-51.57 | 0.92 |
| | FALSE | 44.57-63.76 | 59.99-60.04 | −1.31 | 59.85-60.18 | 0.33 |
| 115 | TRUE | 0.33-30.89 | 8.81-25.63 | −1.39 | 5.91-25.68 | 19.77 |
| 116 | TRUE | 9.96-13.43 | 9.96-10.08 | −1.24 | 9.96-13.43 | 3.47 |
| 117 | TRUE | 31.95-32.5 | 32.16-32.5 | −1.16 | 31.95-32.5 | 0.55 |
| 118 | TRUE | 34.19-36.62 | 35.08-35.42 | −1.09 | 34.81-35.42 | 0.61 |
| 119 | TRUE | 37.01-37.52 | 37.01-37.02 | −1.58 | 37.01-37.52 | 0.5 |
| 120 | TRUE | 39.76-46.94 | 41.7-41.75 | −4.09 | 45.08-45.17 | 0.09 |
| | FALSE | 39.76-46.94 | 41.7-41.75 | −4.09 | 46.77-46.94 | 0.17 |
| 121 | TRUE | 14.49-39.46 | 22.7-22.7 | −1.32 | 20.64-39.46 | 18.83 |

TABLE 4

Markers of the invention which reside in MCRs of deletion and display decreased expression.

| Chromosome | Pos (Mb) | Gene Weight | Minimum p value | Gene Description | Gene Symbol | GI | UGID# |
|---|---|---|---|---|---|---|---|
| 1 | 21.3 | −0.84 | 0.005 | alkaline phosphatase, liver/bone/kidney | ALPL | gi: 28737 | Hs.250769 |
| 1 | 22.8 | −1.12 | <.005 | KIAA0601 protein | KIAA0601 | gi: 3043725 | Hs.348515 |
| 1 | 23.3 | −0.38 | 0.037 | E2F transcription factor 2 | E2F2 | gi: 4758225 | Hs.231444 |
| 1 | 23.5 | −0.73 | <.005 | lysophospholipase II | LYPLA2 | gi: 9966763 | Hs.413781 |
| 1 | 23.5 | −0.39 | 0.049 | galactose-4-epimerase, UDP- | GALE | gi: 9945333 | Hs.76057 |
| 1 | 23.6 | −0.56 | 0.012 | 3-hydroxymethyl-3-methylglutaryl-Coenzyme A lyase (hydroxymethylglutaricaciduria) | HMGCL | gi: 4504426 | Hs.444925 |
| 1 | 23.6 | −0.80 | <.005 | lysophospholipase II | LYPLA2 | gi: 4376011 | Hs.413781 |
| 1 | 23.6 | −0.42 | 0.03 | fucosidase, alpha-L-1, tissue | FUCA1 | gi: 4503802 | Hs.576 |
| 1 | 24.3 | −0.48 | <.005 | serine/arginine repetitive matrix 1 | SRRM1 | gi: 5032118 | Hs.18192 |
| 1 | 24.5 | −0.64 | 0.021 | chloride intracellular channel 4 | CLIC4 | gi: 4588523 | Hs.25035 |
| 1 | 24.9 | −0.61 | 0.005 | hypothetical protein dJ465N24.2.1 | DJ465N24.2.1 | gi: 12005626 | Hs.259412 |
| 1 | 25.8 | −0.87 | <.005 | stathmin l/oncoprotein 18 | STMN1 | gi: 13518023 | Hs.209983 |
| 1 | 26.1 | −0.45 | 0.037 | zinc finger protein | ZT86 | gi: 7705661 | Hs.102419 |
| 1 | 26.4 | −0.44 | 0.021 | high-mobility group nucleosomal binding domain 2 | HMGN2 | gi: 13277559 | Hs.181163 |

TABLE 4-continued

Markers of the invention which reside in MCRs of deletion and display decreased expression.

| | | | | | | |
|---|---|---|---|---|---|---|
| 1 | 26.4 | −0.86 | <.005 | ribosomal protein S6 kinase, 90 kDa, polypeptide 1 | RPS6KA1 | gi: 4506732 Hs.149957 |
| 1 | 26.7 | −0.61 | 0.015 | hypothetical protein FLJ20477 | FLJ20477 | gi: 8923441 Hs.259605 |
| 1 | 26.7 | −0.84 | 0.007 | hypothetical protein FLJ20477 | FLJ20477 | gi: 1799134 Hs.259605 |
| 1 | 26.8 | −2.26 | 0.032 | hypothetical protein FLJ12455 | FLJ12455 | gi: 11545792 Hs.10903 |
| 1 | 28.5 | −0.75 | <.005 | tRNA selenocysteine associated protein | SECP43 | gi: 8923459 Hs.266935 |
| 1 | 28.6 | −0.87 | <.005 | TAF12 RNA polymerase II, TATA box binding protein (TBP)-associated factor, 20 kDa | TAF12 | gi: 1345403 Hs.421646 |
| 1 | 28.7 | −0.63 | 0.016 | glucocorticoid modulatory element binding protein 1 | GMEB1 | gi: 13435376 Hs.4069 |
| 1 | 28.7 | −0.78 | 0.005 | high-glucose-regulated protein 8 | HGRG8 | gi: 7705410 Hs.20993 |
| 1 | 29.1 | −0.47 | 0.032 | splicing factor, arginine/serine-rich 4 | SFRS4 | gi: 5032088 Hs.76122 |
| 1 | 29.2 | −0.57 | 0.008 | nuclear receptor binding factor 1 | CGI-63 | gi: 7705776 Hs.183646 |
| 1 | 31.1 | −0.49 | 0.037 | hypothetical protein FLJ12650 | FLJ12650 | gi: 13375663 Hs.436090 |
| 1 | 32.7 | −0.67 | 0.006 | KIAA1522 protein | KIAA1522 | gi: 6588393 Hs.322735 |
| 1 | 32.9 | −0.63 | 0.017 | hypothetical protein FLJ90005 | FLJ90005 | gi: 6729581 Hs.511807 |
| 1 | 32.9 | −0.27 | <.005 | *Homo sapiens* transcribed sequence with moderate similarity to protein ref: NP_060265.1 (*H. sapiens*) hypothetical protein FLJ20378 [*Homo sapiens*] | | gi: 6664283 Hs.416117 |
| 1 | 33.3 | −0.96 | <.005 | polyhomeotic-like 2 (*Drosophila*) | PHC2 | gi: 4758241 Hs.165263 |
| 3 | 14.1 | −0.86 | <.005 | hypothetical protein MGC3222 | MGC3222 | gi: 1384812 Hs.130330 |
| 3 | 14.1 | −1.30 | <.005 | xeroderma pigmentosum, complementation group C | XPC | gi: 475156 Hs.320 |
| 3 | 14.2 | −0.47 | 0.033 | LSM3 homolog, U6 small nuclear RNA associated (*S. cerevisiae*) | LSM3 | gi: 7657314 Hs.111632 |
| 4 | 153.2 | −0.42 | 0.023 | PET112-like (yeast) | PET112L | gi: 4758893 Hs.119316 |
| 4 | 153.8 | −0.38 | 0.043 | F-box and WD-40 domain protein 7 (archipelago homolog, *Drosophila*) | FBXW7 | gi: 8922851 Hs.312503 |
| 4 | 174.8 | −0.42 | 0.037 | UDP-N-acetyl-alpha-D-galactosamine:polypeptide N-acetylgalactosaminyltransferase 7 (GalNAc-T7) | GALNT7 | gi: 8393408 Hs.156856 |
| 4 | 175 | −0.42 | 0.027 | *Homo sapiens* clone FLB9413 PRO2532 mRNA, complete cds | | gi: 11493455 Hs.383372 |
| 4 | 175.1 | −0.40 | 0.021 | heart and neural crest derivatives expressed 2 | HAND2 | gi: 12545383 Hs.388245 |
| 4 | 184.5 | −0.73 | <.005 | dCMP deaminase | DCTD | gi: 4740472 Hs.76894 |
| 4 | 185 | −0.70 | 0.006 | collaborates/cooperates with ARF (alternate reading frame) protein | CARF | gi: 8923039 Hs.32922 |
| 4 | 186 | −0.74 | <.005 | interferon regulatory factor 2 | IRF2 | gi: 4755144 Hs.83795 |
| 4 | 186.9 | −0.38 | 0.05 | hypothetical protein DKFZp761O0113 | DKFZp761O0113 | gi: 8922176 Hs.42768 |
| 4 | 187 | −0.40 | 0.028 | hypothetical protein FLJ11200 | FLJ11200 | gi: 8922937 Hs.368022 |
| 5 | 128.5 | −2.23 | 0.042 | CGI-111 protein | CGI-111 | gi: 7705613 Hs.11085 |
| 6 | 106.7 | −0.63 | <.005 | APG5 autophagy 5-like (*S. cerevisiae*) | APG5L | gi: 7023451 Hs.11171 |
| 6 | 107.1 | −0.45 | 0.015 | glutaminyl-tRNA synthase (glutamine-hydrolyzing)-like 1 | QRSL1 | gi: 12052881 Hs.406917 |
| 6 | 107.6 | −0.61 | <.005 | chromosome 6 open reading frame 210 | C6orf210 | gi: 9966852 Hs.268733 |
| 6 | 108.2 | −0.95 | <.005 | SEC63-like (*S. cerevisiae*) | SEC63 | gi: 5393231 Hs.330767 |
| 6 | 108.5 | −0.48 | 0.01 | sorting nexin 3 | SNX3 | gi: 6010168 Hs.12102 |
| 6 | 108.6 | −0.53 | 0.007 | sorting nexin 3 | SNX3 | gi: 11765691 Hs.12102 |
| 6 | 109 | −0.24 | 0.014 | | | gi: 3821018 |
| 6 | 109.7 | −0.75 | <.005 | CD164 antigen, sialomucin | CD164 | gi: 11943350 Hs.43910 |
| 6 | 109.8 | −0.77 | <.005 | sphingomyelin phosphodiesterase 2, neutral membrane (neutral sphingomyelinase) | SMPD2 | gi: 5101461 Hs.55235 |
| 6 | 109.8 | −0.76 | <.005 | NEDD9 interacting protein with calponin homology and LIM domains | NICAL | gi: 12232438 Hs.33476 |
| 6 | 109.8 | −0.54 | 0.008 | zinc finger protein 450 | ZNF450 | gi: 7662127 Hs.409876 |
| 6 | 110.1 | −0.36 | 0.04 | KIAA0274 | KIAA0274 | gi: 7662033 Hs.419998 |
| 6 | 110.5 | −0.52 | <.005 | WAS protein family, member 1 | WASF1 | gi: 4507912 Hs.75850 |
| 6 | 110.5 | −0.94 | <.005 | cell division cycle 40 homolog (yeast) | CDC40 | gi: 7706656 Hs.116674 |
| 6 | 110.9 | −1.03 | <.005 | cyclin-dependent kinase (CDC2-like) 11 | CDK11 | gi: 5100783 Hs.129836 |
| 6 | 111 | −1.36 | <.005 | cyclin-dependent kinase (CDC2-like) 11 | CDK11 | gi: 5689392 Hs.129836 |
| 6 | 111.2 | −0.41 | <.005 | adenosylmethionine decarboxylase 1 | AMD1 | gi: 178517 Hs.159118 |
| 6 | 111.7 | −0.76 | <.005 | REV3-like, catalytic subunit of DNA polymerase zeta (yeast) | REV3L | gi: 4506482 Hs.232021 |
| 6 | 114.3 | −0.72 | <.005 | histone deacetylase 2 | HDAC2 | gi: 4557640 Hs.3352 |
| 6 | 116.6 | −0.84 | <.005 | TSPY-like | TSPYL | gi: 12052783 Hs.458358 |
| 6 | 119.2 | −0.10 | <.005 | ASF1 anti-silencing function 1 homolog A (*S. cerevisiae*) | ASF1A | gi: 7661591 Hs.292316 |
| 6 | 135.3 | −0.65 | 0.019 | HBS1-like (*S. cerevisiae*) | HBS1L | gi: 6703779 Hs.221040 |
| 6 | 135.6 | −0.57 | 0.016 | Abelson helper integration stie | AHI1 | gi: 8923074 Hs.273294 |
| 6 | 136.9 | −0.29 | 0.024 | mitogen-activated protein kinase kinase kinase 5 | MAP3K5 | gi: 1805499 Hs.151988 |
| 6 | 137.3 | −0.58 | <.005 | interleukin 20 receptor, alpha | IL20RA | gi: 7657690 Hs.288240 |
| 6 | 138.7 | −0.52 | 0.012 | heme binding protein 2 | HEBP2 | gi: 7657602 Hs.439081 |
| 6 | 139 | −0.74 | <.005 | chromosome 6 open reading frame 80 | C6orf80 | gi: 12653928 Hs.44468 |
| 6 | 139.4 | −0.45 | 0.024 | headcase homolog (*Drosophila*) | HECA | gi: 7706434 Hs.6679 |
| 6 | 146.5 | −0.76 | <.005 | glutamate receptor, metabotropic 1 | GRM1 | gi: 6006005 Hs.32945 |
| 6 | 169.8 | −0.25 | 0.047 | PHD finger protein 10 | PHF10 | gi: 11085906 Hs.435933 |

TABLE 4-continued

Markers of the invention which reside in MCRs of deletion and display decreased expression.

| | | | | | | | |
|---|---|---|---|---|---|---|---|
| 6 | 169.8 | −0.61 | 0.011 | PHD finger protein 10 | PHF10 | gi: 8922799 | Hs.435933 |
| 8 | 18 | −0.44 | 0.026 | N-acetyltransferase 1 (arylamine N-acetyltransferase) | NAT1 | gi: 4505334 | Hs.458430 |
| 8 | 18.3 | −0.65 | <.005 | hypothetical protein DKFZp761K1423 | DKFZp761K1423 | gi: 8922171 | Hs.236438 |
| 8 | 18.5 | −0.68 | <.005 | ADP-ribosylation factor guanine nucleotide factor 6 | EFA6R | gi: 6085952 | Hs.408177 |
| 8 | 20 | −0.75 | <.005 | ATPase, H+ transporting, lysosomal 56/58 kDA, V1 subunit B, isoform 2 | ATP6V1B2 | gi: 4502310 | Hs.295917 |
| 8 | 28.6 | −0.40 | 0.042 | exostoses (multiple)-like 3 | EXTL3 | gi: 2897904 | Hs.9018 |
| 8 | 28.6 | −0.49 | 0.02 | exostoses (multiple)-like 3:exostoses (multiple)-like 3 | EXTL3 | gi: 13623512 | Hs.9018; Hs.9018 |
| 8 | 28.7 | −0.80 | <.005 | hypothetical protein FLJ10871 | FLJ10871 | gi: 8922725 | Hs.15562 |
| 8 | 29.9 | −0.99 | <.005 | hypothetical protein MGC8721 | MGC8721 | gi: 7706384 | Hs.279921 |
| 8 | 30 | −0.96 | <.005 | leptin receptor overlapping transcript-like 1 | LEPROTL1 | gi: 7662509 | Hs.146585 |
| 8 | 30 | −0.80 | <.005 | dynactin 6 | DCTN6 | gi: 5730115 | Hs.158427 |
| 8 | 30.3 | −0.22 | 0.034 | RNA binding protein with multiple splicing | RBPMS | gi: 5803140 | Hs.195825 |
| 8 | 30.5 | −0.56 | <.005 | general transcription factor IIE, polypeptide 2, beta 34 kDA | GTF2E2 | gi: 4504194 | Hs.77100 |
| 8 | 30.6 | −0.84 | <.005 | glutathione reductase | GSR | gi: 10835188 | Hs.414334 |
| 8 | 30.6 | −0.42 | 0.022 | reproduction 8 | D8S2298E | gi: 1913786 | Hs.153678 |
| 8 | 30.7 | −0.46 | <.005 | protein phosphatase 2 (formerly 2A), catalytic subunit, beta isoform | PPP2CB | gi: 4758951 | Hs.80350 |
| 8 | 32.6 | −0.08 | 0.039 | neuregulin 1 | NRG1 | gi: 7669513 | Hs.172816 |
| 8 | 33.4 | −1.04 | <.005 | RNA binding protein; RNA binding protein | LOC84549 | gi: 13625185 | Hs.77135; Hs.77135 |
| 8 | 33.4 | −0.53 | <.005 | hypothetical protein FLJ23263 | FLJ23263 | gi: 13376690 | Hs.288716 |
| 8 | 37.6 | −0.75 | <.005 | chromosome 8 open reading frame 2; chromosome 8 open reading frame 2 | C8orf2 | gi: 10241715 | Hs.125849; Hs.125849 |
| 8 | 37.6 | −1.00 | <.005 | proline synthetase co-transcribed homolog (bacterial) | PROSC | gi: 6005841 | Hs.301959 |
| 8 | 131.3 | −0.17 | 0.021 | Homo sapiens cDNA: FLJ23601 fis, clone LNG15501 | | gi: 10440343 | Hs.306918 |
| 9 | 2.1 | −0.36 | 0.026 | SWI/SNF related, matrix associated, actin dependent regulator of chromatin, subfamily a, member 2 | SMARCA2 | gi: 6133361 | Hs.396404 |
| 9 | 2.6 | −0.47 | 0.013 | very low density lipoprotein receptor | VLDLR | gi: 437386 | Hs.370422 |
| 9 | 2.8 | −1.06 | <.005 | minor histocompatibility antigen HA-8 | XTP5 | gi: 7661865 | Hs.443866 |
| 9 | 5.3 | −0.77 | <.005 | chromosome 9 open reading frame 46 | C9orf46 | gi: 8923931 | Hs.416649 |
| 9 | 5.5 | −0.51 | 0.007 | programmed cell death 1 ligand 2 | PDCD1LG2 | gi: 13376849 | Hs.61929 |
| 9 | 6 | −1.15 | <.005 | RAN binding protein 6 | RANBP6 | gi: 3538999 | Hs.167496 |
| 9 | 14 | −0.20 | <.005 | nuclear factor I/B | NFIB | gi: 13410807 | Hs.302690 |
| 9 | 14.2 | −0.50 | <.005 | nuclear factor I/B | NFIB | gi: 4988418 | Hs.302690 |
| 9 | 15.4 | −0.56 | <.005 | small nuclear RNA activating complex, polypeptide 3, 50 kDa | SNAPC3 | gi: 4507104 | Hs.380092 |
| 9 | 15.4 | −0.65 | <.005 | PC4 and SFRS1 interacting protein 2 | PSIP2 | gi: 3283351 | Hs.351305 |
| 9 | 19 | −0.94 | <.005 | Ras-related GTP binding A | RRAGA | gi: 5729998 | Hs.432330 |
| 9 | 19 | −0.43 | 0.026 | hypothetical protein FLJ20060 | FLJ20060 | gi: 8923062 | Hs.54617 |
| 9 | 19.3 | −0.91 | <.005 | ribosomal protein S6 | RPS6 | gi: 4506730 | Hs.408073 |
| 9 | 20.8 | −1.14 | <.005 | KIAA1797 | KIAA1797 | gi: 8923357 | Hs.257696 |
| 9 | 21.3 | −1.03 | <.005 | KIAA1354 protein | KIAA1354 | gi: 2185814 | Hs.147717 |
| 9 | 21.9 | 0.00 | 0.015 | cyclin-dependent kinase inhibitor 2A (melanoma, p16, inhibits CDK4) | CDKN2A | gi: 4502748 | Hs.421349 |
| 9 | 22 | −0.15 | <.005 | methylthioadenosine phosphorylase | MTAP | gi: 4378719 | Hs.459541 |
| 12 | 42.4 | −1.31 | <.005 | PTK9 protein tyrosine kinase 9; PTK9 protein tyrosine kinase 9 | PTK9 | gi: 4506274 | Hs.189075; Hs.189075 |
| 12 | 43.8 | −1.03 | 0.015 | putative glycolipid transfer protein | LOC51054 | gi: 7705683 | Hs.334649 |
| 12 | 44.6 | −0.94 | 0.006 | splicing factor, arginine/serine-rich 2, interacting protein | SFRS2IP | gi: 4759171 | Hs.210367 |
| 12 | 46.4 | −1.06 | 0.047 | hypothetical protein FLJ20489 | FLJ20489 | gi: 8923451 | Hs.438867 |
| 12 | 46.5 | −2.40 | 0.043 | vitamin D (1,25-dihydroxyvitamin D3) receptor | VDR | gi: 2824068 | Hs.2062 |
| 12 | 47.3 | −0.54 | 0.036 | hypothetical protein FLJ20436 | FLJ20436 | gi: 10434303 | Hs.268189 |
| 12 | 47.5 | −0.89 | 0.007 | calcium channel, voltage-dependent, beta 3 subunit | CACNB3 | gi: 463890 | Hs.250712 |
| 12 | 47.5 | −0.82 | 0.007 | calcium channel, voltage-dependent, beta 3 subunit | CACNB3 | gi: 463890 | Hs.250712 |
| 12 | 47.5 | −0.58 | 0.028 | DEAD (Asp-Glu-Ala-Asp) box polypeptide 23 | DDX23 | gi: 2655201 | Hs.130098 |
| 12 | 47.6 | −0.72 | 0.023 | FK506 binding protein 11, 19 kDa | FKBP11 | gi: 7706130 | Hs.438695 |
| 12 | 47.6 | −0.61 | 0.019 | ADP-ribosylation factor 3 | ARF3 | gi: 4502202 | Hs.119177 |
| 12 | 47.6 | −1.26 | <.005 | ADP-ribosylation factor 3; ADP-ribosylation factor 3 | ARF3 | gi: 178980 | Hs.119177; Hs.119177 |
| 12 | 47.6 | −0.48 | 0.045 | protein kinase, AMP-activated, gamma 1 non-catalytic subunit | PRKAG1 | gi: 4506060 | Hs.3136 |
| 12 | 47.7 | −0.58 | 0.028 | lipocalin-interacting membrane receptor | LIMR | gi: 8922462 | Hs.272838 |
| 12 | 48.1 | −1.12 | <.005 | spermatogenesis associated, serine-rich 2 | SPATS2 | gi: 12751480 | Hs.152982 |
| 12 | 48.2 | −1.25 | <.005 | microsphaerule protein 1 | MCRS1 | gi: 5453693 | Hs.25313 |
| 12 | 48.4 | −1.09 | <.005 | testis enhanced gene transcript (BAX inhibitor 1) | TEGT | gi: 2645728 | Hs.35052 |

TABLE 4-continued

Markers of the invention which reside in MCRs of deletion and display decreased expression.

| | | | | | | | |
|---|---|---|---|---|---|---|---|
| 12 | 48.6 | −0.55 | 0.03 | Rac GTPase activating protein 1 | RACGAP1 | gi: 11015369 | Hs.23900 |
| 12 | 49.6 | −1.33 | 0.034 | solute carrier family 11 (proton-coupled divalent metal ion transporters), member 2 | SLC11A2 | gi: 11015990 | Hs.57435 |
| 12 | 49.8 | −2.85 | 0.034 | transcription factor CP2 | TFCP2 | gi: 5032174 | Hs.154970 |
| 12 | 49.9 | −1.32 | <.005 | DAZ associated protein 2 | DAZAP2 | gi: 7661885 | Hs.369761 |
| 12 | 49.9 | −0.66 | 0.032 | hypothetical protein from clone 643 | LOC57228 | gi: 13097236 | Hs.206501 |
| 12 | 50.6 | −0.44 | 0.043 | activin A receptor, type IB | ACVR1B | gi: 12652986 | Hs.371974 |
| 12 | 50.6 | −0.58 | 0.035 | activin A receptor, type IB | ACVR1B | gi: 5912233 | Hs.371974 |
| 12 | 50.7 | −0.57 | 0.035 | Homo sapiens cDNA clone IMAGE: 5590288, partial cds | | gi: 7152120 | Hs.444433 |
| 12 | 51.7 | −1.36 | 0.012 | eukaryotic translation initiation factor 4B | EIF4B | gi: 4503532 | Hs.93379 |
| 12 | 51.8 | −1.11 | 0.009 | retinoic acid receptor, gamma | RARG | gi: 307424 | Hs.1497 |
| 12 | 51.9 | −0.78 | 0.04 | hypothetical protein MGC11308 | MGC11308 | gi: 11975558 | Hs.19210 |
| 12 | 51.9 | −1.36 | <.005 | prefoldin 5 | PFDN5 | gi: 4505742 | Hs.288856 |
| 12 | 51.9 | −0.76 | 0.044 | chromosome 12 open reading frame 10 | C12orf10 | gi: 11056017 | Hs.400801 |
| 12 | 52.6 | −0.56 | 0.042 | homeo box C11 | HOXC11 | gi: 7657165 | Hs.127562 |
| 12 | 52.7 | −0.73 | 0.01 | homeo box C6 | HOXC6 | gi: 6709275 | Hs.820 |
| 12 | 52.8 | −1.85 | <.005 | single-strand selective monofunctional uracil DNA glycosylase | SMUG1 | gi: 7657596 | Hs.5212 |
| 12 | 52.9 | −1.16 | 0.012 | Homo sapiens, clone IMAGE: 5288883, mRNA | | gi: 13284730 | Hs.349283 |
| 12 | 52.9 | −1.60 | 0.034 | heterogeneous nuclear ribonucleoprotein A1 | HNRPA1 | gi: 4504444 | Hs.356721 |
| 12 | 53 | −4.54 | 0.034 | costomer protein complex, subunit zeta 1 | COPZ1 | gi: 7706336 | Hs.181271 |
| 12 | 54.3 | −1.01 | <.005 | GCN5 general control of amino-acid synthesis 5-like 1 (yeast) | GCN5L1 | gi: 4503954 | Hs.94672 |
| 12 | 54.4 | −2.59 | <.005 | CD63 antigen (melanoma 1 antigen) | CD63 | gi: 4502678 | Hs.445570 |
| 12 | 54.4 | −1.52 | 0.013 | ORM1-like 2 (S. cerevisiae) | ORMDL2 | gi: 7661819 | Hs.13144 |
| 12 | 63.1 | −0.90 | 0.005 | exportin, tRNA (nuclear export receptor for tRNAs) | XPOT | gi: 5811224 | Hs.85951 |
| 12 | 63.1 | −0.76 | 0.014 | TANK-binding kinase 1 | TBK1 | gi: 7019546 | Hs.432466 |
| 12 | 63.3 | −1.23 | <.005 | glucosamine (N-acetyl)-6-sulfatase (Sanfilippo disease IIID) | GNS | gi: 10329021 | Hs.334534 |
| 12 | 63.4 | −0.78 | 0.013 | glucosamine (N-acetyl)-6-sulfatase (Sanfilippo disease IIID) | GNS | gi: 4504060 | Hs.334534 |
| 12 | 63.8 | −1.13 | 0.006 | integral inner nuclear membrane protein | MAN1 | gi: 7706606 | Hs.105234 |
| 12 | 64.8 | −0.71 | 0.012 | CGI-119 protein | CGI-119 | gi: 7706334 | Hs.126372 |
| 12 | 65.9 | −0.73 | 0.005 | TBP-interacting protein | TIP120A | gi: 8924259 | Hs.512638 |
| 12 | 65.9 | −0.79 | <.005 | TBP-interacting protein | TIP120A | gi: 4240146 | Hs.512638 |
| 12 | 66.3 | −0.70 | 0.006 | dual-specificity tyrosine-(Y)-phosphorylation regulated kinase 2 | DYRK2 | gi: 1666065 | Hs.173135 |
| 12 | 67.3 | −0.97 | <.005 | RAP1B, member of RAS oncogene family | RAP1B | gi: 7661677 | Hs.374418 |
| 12 | 67.4 | −0.52 | 0.031 | solute carrier family 35, member E2 | SLC35E3 | gi: 8922084 | Hs.445043 |
| 12 | 68 | −0.80 | 0.005 | glioma-amplified sequence-41 | GAS41 | gi: 5729837 | Hs.4029 |
| 12 | 68.2 | −0.53 | 0.05 | chaperonin containing TCP1, subunit 2 (beta) | CCT2 | gi: 5453602 | Hs. 189772 |
| 12 | 78.7 | −0.98 | <.005 | protein phosphatase 1, regulatory (inhibitor) subunit 12A | PPP1R12A | gi: 5436140 | Hs.377908 |
| 12 | 81.2 | −0.81 | <.005 | HSPC128 protein | HSPC128 | gi: 7661789 | Hs.90527 |
| 12 | 86.9 | −0.86 | <.005 | hypothetical protein DKFZp434N2030 | DKFZp434N2030 | gi: 6708922 | Hs.494204 |
| 12 | 87 | −0.52 | 0.045 | hypothetical protein FLJ13615 | FLJ13615 | gi: 12711597 | Hs.288715 |
| 12 | 87.4 | −0.47 | 0.03 | KIT ligand | KITLG | gi: 4505174 | Hs.1048 |
| 12 | 88.2 | −0.45 | 0.027 | dual specificity phosphatase 6 | DUSP6 | gi: 13111942 | Hs.298654 |
| 12 | 88.4 | −0.88 | 0.006 | ATPase, Ca++ transporting, plasma membrane 1 | ATP2B1 | gi: 7247996 | Hs.20952 |
| 12 | 88.5 | −0.73 | <.005 | ATPase, Ca++ transporting, plasma membrane 1 | ATP2B1 | gi: 184269 | Hs.20952 |
| 12 | 91 | −0.65 | 0.008 | B-cell translocation gene 1, anti-proliferative | BTG1 | gi: 4502472 | Hs.255935 |
| 16 | 2.5 | −0.60 | 0.026 | ATPase, H+ transporting, lysosomal 16 kDa, V0 subunit c | ATP6V0C | gi: 4502312 | Hs.389107 |
| 16 | 2.5 | −0.62 | 0.019 | ATPase, H+ transporting, lysosomal 16 kDa, V0 subunit c | ATP6V0C | gi: 189675 | Hs.389107 |
| 16 | 2.5 | −0.70 | <.005 | CGI-14 protein | CGI-14 | gi: 7705595 | Hs.433499 |
| 16 | 2.5 | −0.14 | 0.02 | 3-phosphoinositide dependent protein kinase-1 | PDPK1 | gi: 4505694 | Hs.154729 |
| 16 | 2.5 | −0.92 | <.005 | 3-phosphoinositide dependent protein kinase-1 | PDPK1 | gi: 2407612 | Hs.154729 |
| 16 | 2.8 | −0.15 | <.005 | serine/arginine repetitive matrix 2 | SRRM2 | gi: 4739778 | Hs.433343 |
| 16 | 2.8 | −0.61 | 0.01 | serine/arginine repetitive matrix 2 | SRRM2 | gi: 4531907 | Hs.433343 |
| 17 | 45.4 | −0.10 | 0.011 | golgi SNAP receptor complex member 2 | GOSR2 | gi: 12711466 | Hs.432552 |
| 18 | 37.8 | −0.70 | <.005 | phosphoinositide-3-kinase, class 3 | PIK3C3 | gi: 4505800 | Hs.418150 |
| 18 | 41.9 | −0.70 | <.005 | ATP synthase, H+ transporting, mitochondrial F1 complex, alpha subunit, isoform 1, cardiac muscle | ATP5A1 | gi: 4573764 | Hs.298280 |
| 18 | 42.6 | −0.41 | 0.031 | Msx-interacting-zinc finger | MIZ1 | gi: 10720797 | Hs.441069 |
| 18 | 42.6 | −0.50 | 0.008 | Msx-interacting-zinc finger | MIZ1 | gi: 3643114 | Hs.441069 |
| 18 | 42.9 | −0.60 | 0.006 | HSPC039 protein | HSPC039 | gi: 7770186 | Hs.406542 |
| 18 | 66.1 | −0.42 | 0.034 | suppressor of cytokine signaling 4 | SOCS4 | gi: 4757991 | Hs.44439 |
| 18 | 72.8 | −0.48 | 0.011 | myelin basic protein | MBP | gi: 4505122 | Hs.408543 |

TABLE 4-continued

Markers of the invention which reside in MCRs of deletion and display decreased expression.

| | | | | | | | |
|---|---|---|---|---|---|---|---|
| 18 | 75.3 | −0.31 | 0.005 | nuclear factor of activated T-cells, cytoplasmic, calcineurin-dependent 1 | NFATC1 | gi: 500631 | Hs.512591 |
| 38 | 75.5 | −0.60 | <.005 | CTD (carboxy-terminal domain, RNA polymerase II; polypeptide A) phosphatase, subunit 1 | CTDP1 | gi: 4758093 | Hs.4076 |
| 18 | 75.7 | −0.58 | <.005 | hypothetical protein FLJ22378 | FLJ22378 | gi: 13376629 | Hs.288284 |
| 18 | 75.8 | −0.61 | <.005 | similar to S. pombe dim1+ | DIM1 | gi: 12654440 | Hs.433683 |
| 18 | 75.8 | −0.53 | <.005 | hypothetical protein FLJ21172 | FLJ21172 | gi: 13376184 | Hs.444642 |
| 18 | 75.9 | −0.28 | <.005 | KIAA0863 protein | KIAA0863 | gi: 10434228 | Hs.131915 |
| 19 | 51.5 | −0.81 | 0.018 | protein phosphatase 5, catalytic subunit | PPP5C | gi: 5453957 | Hs.431861 |
| 19 | 59.3 | −0.32 | <.005 | PRP31 pre-mRNA processing factor 31 homolog (yeast) | PRPF31 | gi: 7661653 | Hs.312927 |
| 19 | 59.9 | −0.40 | 0.047 | killer cell immunoglobulin-like receptor, two domains, long cytoplasmic tail, 1 | KIR2DL1 | gi: 897908 | Hs.512572 |
| 19 | 60.1 | −0.18 | 0.016 | natural cytotoxicity triggering receptor 1 | NCR1 | gi: 4758691 | Hs.97084 |
| 21 | 45 | −0.51 | 0.025 | SMT3 suppressor of mif two 3 homolog 1 (yeast) | SMT3H1 | gi: 5902095 | Hs.85119 |
| 21 | 45.1 | −0.84 | <.005 | pituitary tumor-transforming 1 interacting protein | PTTG1IP | gi: 11038670 | Hs.369026 |
| 21 | 46.9 | −0.31 | 0.05 | HMT1 hnRNP methyltransferase-like 1 (S. cerevisiae) | HRMT1L1 | gi: 4504494 | Hs.154163 |
| 22 | 21.3 | −0.42 | 0.038 | POM121 membrane glycoprotein-like 1 (rat) | POM121L1 | gi: 7657468 | Hs.380370 |
| 22 | 21.3 | −0.57 | 0.012 | immunoglobulin lambda joining 3 | IGLJ3 | gi: 13171335 | Hs.102950 |
| 22 | 21.8 | −0.50 | 0.015 | RAB36, member RAS oncogene family | RAB36 | gi: 6049163 | Hs.369557 |
| 22 | 21.9 | −0.64 | <.005 | breakpoint cluster region | BCR | gi: 11038638 | Hs.446394 |
| 22 | 22.2 | −0.65 | 0.009 | immunoglobulin lambda-like polypeptide 1 | IGLL1 | gi: 13399297 | Hs.348935 |
| 22 | 22.3 | −0.52 | 0.013 | Homo sapiens, clone IMAGE: 5728597, mRNA | | gi: 292400 | Hs.272302 |
| 22 | 22.4 | −0.45 | 0.03 | matrix metalloproteinase 11 (stromelysin 3) | MMP11 | gi: 5177469 | Hs.143751 |
| 22 | 22.4 | −1.28 | <.005 | SWI/SNF related, matrix associated, actin dependent regulator of chromatin, subfamily b, member 1 | SMARCB1 | gi: 4507076 | Hs.512700 |
| 22 | 22.7 | −1.44 | <.005 | glutathione S-transferase theta 1 | GSTT1 | gi: 4504184 | Hs.268573 |
| 22 | 23.2 | −0.58 | 0.028 | small nuclear ribonucleoprotein D3 | SNRPD3 | gi: 4759159 | Hs.356549 |
| 22 | 25.1 | −0.48 | 0.014 | Hermansky-Pudlak syndrome 4 | HPS4 | gi: 5420802 | Hs.441481 |
| 22 | 25.1 | −0.64 | <.005 | Hermansky-Pudlak syndrome 4 | HPS4 | gi: 11559920 | Hs.441481 |
| 22 | 25.2 | −0.15 | <.005 | tuftelin interacting protein 11 | TFIP11 | gi: 5262598 | Hs.20225 |
| 22 | 25.3 | −0.52 | 0.046 | crystallin, beta A4 | CRYBA4 | gi: 4503058 | Hs.57690 |
| 22 | 26.4 | −0.67 | 0.033 | meningioma (disrupted in balanced translocation) 1 | MN1 | gi: 4505222 | Hs.268515 |
| 22 | 27.4 | −0.73 | 0.035 | CHK2 checkpoint homolog (S. pombe) | CHEK2 | gi: 13278893 | Hs.146329 |
| 22 | 28.2 | −0.07 | 0.033 | chromosome 22 open reading frame 19 | C22orf19 | gi: 13177658 | Hs.75361 |
| 22 | 28.5 | −0.55 | 0.024 | ASC-1 complex subunit P100 | ASC1p100 | gi: 5419897 | Hs.436407 |
| 22 | 29 | −0.84 | <.005 | splicing factor 3a, subunit 1, 120 kDa | SF3A1 | gi: 5032086 | Hs.406277 |
| 22 | 29.1 | −0.87 | <.005 | SEC14-like 2 (S. cerevisiae) | SEC14L2 | gi: 7110714 | Hs.430576 |
| 22 | 30 | −1.48 | <.005 | zinc finger protein 278 | ZNF278 | gi: 9954374 | Hs.27801 |
| 22 | 30.2 | −0.73 | <.005 | KIAA0542 gene product | KIAA0542 | gi: 6635200 | Hs.62209 |
| 22 | 30.2 | −1.14 | <.005 | KIAA0542 gene product | KIAA0542 | gi: 3043607 | Hs.62209 |
| 22 | 30.3 | −0.66 | <.005 | phosphatidylserine decarboxylase | PISD | gi: 13489111 | Hs.8128 |
| 22 | 30.3 | −0.84 | <.005 | KIAA0542 gene product | KIAA0542 | gi: 5596770 | Hs.62209 |
| 22 | 30.6 | −0.72 | <.005 | KIAA0645 gene product | KIAA0645 | gi: 7662221 | Hs.435022 |
| 22 | 30.6 | −0.45 | 0.021 | tyrosine 3-monooxygenase/tryptophan 5-mono-xygenase activation protein, eta polypeptide | YWHAH | gi: 4507950 | Hs.226755 |
| 22 | 31.2 | −0.72 | 0.011 | Homo sapiens, clone IMAGE: 4818531, mRNA | | gi: 10030150 | Hs.150167 |
| 22 | 31.5 | −0.50 | 0.027 | tissue inhibitor of metalloproteinase 3 (Sorsby fundus dystrophy, pseudoinflammatory) | TIMP3 | gi: 1519557 | Hs.245188 |
| 22 | 34 | −0.37 | 0.047 | target of myb1 (chicken) | TOM1 | gi: 4885636 | Hs.9482 |
| 22 | 34.3 | −0.48 | 0.039 | apolipoprotein L, 6 | APOL6 | gi: 13449280 | Hs.257352 |
| 22 | 34.4 | −0.76 | <.005 | RNA binding motif protein 9 | RBM9 | gi: 1267308 | Hs.433574 |
| 22 | 34.8 | −0.62 | 0.013 | apolipoprotein L, 3 | APOL3 | gi: 7656972 | Hs.241535 |
| 22 | 34.9 | −0.66 | <.005 | apolipoprotein L, 2 | APOL2 | gi: 13325155 | Hs.398037 |
| 22 | 34.9 | −0.44 | 0.032 | myosin, heavy polypeptide 9, non-muscle | MYH9 | gi: 5448699 | Hs.146550 |
| 22 | 35 | −0.84 | <.005 | thioredoxin 2 | TXN2 | gi: 4200326 | Hs.211929 |
| 22 | 35.1 | −1.23 | <.005 | thioredoxin 2 | TXN2 | gi: 9280552 | Hs.211929 |
| 22 | 35.1 | −1.11 | <.005 | eukaryotic translation initiation factor 3, subunit 7 zeta, 66/67 kDa | EIF3S7 | gi: 4503522 | Hs.55682 |
| 22 | 35.6 | −0.37 | 0.046 | thiosulfate sulfurtransferase (rhodanese) | TST | gi: 1877030 | Hs.351863 |
| 22 | 35.6 | −0.64 | 0.005 | mercaptopyruvate sulfurtransferase | MPST | gi: 13489090 | Hs.248267 |
| 22 | 35.6 | −0.58 | 0.01 | hypothetical protein FLJ12242 | FLJ12242 | gi: 13489098 | Hs.94810 |
| 22 | 36.1 | −0.53 | 0.033 | manic fringe homolog (Drosophila) | MFNG | gi: 5175720 | Hs.371768 |
| 22 | 36.1 | −0.20 | 0.015 | caspase recruitment domain family, member 10 | CARD10 | gi: 5877877 | Hs.57973 |
| 22 | 36.2 | −1.08 | <005 | golgi associated, gamma adaptin ear containing, ARF binding protein 1 | GGA1 | gi: 9558728 | Hs.405689 |
| 22 | 36.2 | −0.62 | 0.023 | golgi associated, gamma adaptin ear containing, ARF binding protein 1 | GGA1 | gi: 5858473 | Hs.405689 |

TABLE 4-continued

Markers of the invention which reside in MCRs of deletion and display decreased expression.

| | | | | | | | |
|---|---|---|---|---|---|---|---|
| 22 | 36.2 | −0.61 | 0.026 | SH3-domain binding protein 1 | SH3BP1 | gi: 11545732 | Hs.511954 |
| 22 | 36.4 | −0.76 | 0.021 | glycine C-acetyltransferase (2-amion-3-ketobutyrate coenzyme A ligase) | GCAT | gi: 7657117 | Hs.54609 |
| 22 | 36.5 | −1.41 | >.005 | polymerase (RNA) II (DNA directed) polypeptide F | POLR2F | gi: 1309770 | Hs.46405 |
| 22 | 36.9 | −1.89 | 0.042 | casein kinase 1, epsilon | CSNK1E | gi: 6471575 | Hs.355669 |
| 22 | 37.1 | −0.88 | <.005 | KDEL (Lys-Asp-Glu-Leu) endoplasmic reticulum protein retention receptor 3 | KDELR3 | gi: 8051612 | Hs.250696 |
| 22 | 37.1 | −0.54 | 0.026 | DMC1 dosage suppressor of mck1 homolog meiosis-specific homologens recombination (yeast) | DMC1 | gi: 106600 | Hs.339396 |
| 22 | 37.3 | −0.48 | 0.028 | chromosome 22 open reading frame 2 | C22orf2 | gi: 7656941 | Hs.334911 |
| 22 | 37.3 | −0.47 | 0.038 | transiocase of outer mitochondrial membrane 22 homolog (yeast) | TOMM22 | gi: 9910381 | Hs.285005 |
| 22 | 37.3 | −0.75 | <.005 | KIAA0063 gene product | KIAA0063 | gi: 7661887 | Hs.3094 |
| 22 | 37.3 | −0.41 | 0.036 | unc-84 homolog B (*C. elegans*) | UNC84B | gi: 4582132 | Hs.406612 |
| 22 | 37.3 | −0.50 | 0.016 | GTP binding protein 1 | GTPBP1 | gi: 1916924 | Hs.283677 |
| 22 | 37.3 | −1.04 | <.005 | GTP binding protein 1 | GTPBP1 | gi: 7661735 | Hs.283677 |
| 22 | 37.8 | −0.43 | 0.008 | platelet-derived growth factor beta polypeptide (sitnian sarcoma viral (v-sis) oncogene homolog) | PDGFB | gi: 11012269 | Hs.1976 |
| 22 | 38 | −0.54 | 0.042 | mitogen-activated protein kinase kinase kinase 7 interacting protein 1 | MAP3K7IP1 | gi: 5174702 | Hs.403927 |
| 22 | 38.1 | −0.56 | 0.047 | mannosyl (beta-1,4-)-glycoprotein beta-1,4-N-acetylglucosaminyltransferase | MGAT3 | gi: 6031184 | Hs.276808 |
| 22 | 38.1 | −0.64 | 0.03 | hypothetical protein FLJ20232 | FLJ20232 | gi: 12803520 | Hs.505742 |
| 22 | 38.1 | −0.62 | 0.018 | hypothetical protein FLJ20232 | FLJ20232 | gi: 1524716 | Hs.505742 |
| 22 | 38.1 | −0.48 | 0.041 | activating transcription factor 4 (tax-responsive enhancer element B67) | ATF4 | gi: 4502264 | Hs.181243 |
| 22 | 38.2 | −0.52 | 0.043 | mannosyl (beta-1,4-)-glycoprotein beta-1,4-N-acetylglucosaminyltransferase | MGAT3 | gi: 4914501 | Hs.276808 |
| 22 | 39 | −0.26 | 0.022 | hypothetical protein DJ1042K10.2 | DJ1042K10.2 | gi: 11034850 | Hs.22129 |

| Chromosome | Locus Link | Regulation | Probes | Ref Seq mRna ID | SEQ ID NO.: Nuc. | Ref Seq Prot ID | SEQ ID NO.: A.A. |
|---|---|---|---|---|---|---|---|
| 1 | 249 | DOWN | 215783_s_at | NM_000478 | 427 | NP_000469 | 1178 |
| 1 | 23028 | DOWN | 212348_s_at | NM_015013 | 428 | NP_055828 | 1179 |
| 1 | 1870 | DOWN | 207042_at | NM_004091 | 429 | NP_004082 | 1180 |
| 1 | 11313 | DOWN | 202292_x_at | NM_007260 | 430 | NP_009191 | 1181 |
| 1 | 2582 | DOWN | 202528_at | NM_000403 | 431 | NP_000394 | 1182 |
| 1 | 3155 | DOWN | 202772_at | NM_000191 | 432 | NP_000182 | 1183 |
| 1 | 11313 | DOWN | 215568_x_at | NM_007260 | 433 | NP_009191 | 1184 |
| 1 | 2517 | DOWN | 202838_at | NM_000147 | 434 | NP_000138 | 1185 |
| 1 | 10250 | DOWN | 201225_s_at | NM_005839 | 435 | NP_005830 | 1186 |
| 1 | 25932 | DOWN | 201559_s_at | NM_013943 | 436 | NP_039234 | 1187 |
| 1 | 57035 | DOWN | 209006_s_at | NM_020317 | 437 | NP_064713 | 1188 |
| 1 | 3925 | DOWN | 200783_s_at | NM_005563 | 438 | NP_005554 | 1189 |
| 1 | 51042 | DOWN | 204175_at | NM_015871 | 439 | NP_056955 | 1190 |
| 1 | 3151 | DOWN | 208668_x_at | NM_005517 | 440 | NP_005508; NP_116138 | 1191 |
| 1 | 6195 | DOWN | 203379_at | NM_002953 | 441 | NP_002944 | 1192 |
| 1 | 55650 | DOWN | 219238_at | NM_017837 | 442 | NP_060307 | 1193 |
| 1 | 55650 | DOWN | 51146_at | NM_017837 | 443 | NP_060307 | 1194 |
| 1 | 63906 | DOWN | 218895_at | NM_022078 | 444 | NP_071361 | 1195 |
| 1 | 54952 | DOWN | 218977_s_at | NM_017846 | 446 | NP_060316 | 1197 |
| 1 | 6883 | DOWN | 209463_s_at | NM_005644 | 447 | NP_005635 | 1198 |
| 1 | 10691 | DOWN | 220938_s_at | NM_006582; NM_024482 | 448; 449 | NP_006573; NP_077808 | 1199; 1200 |
| 1 | 51441 | DOWN | 217812_at | NM_016258 | 450 | NP_057342 | 1201 |
| 1 | 6429 | DOWN | 201696_at | NM_005626 | 451 | NP_005617 | 1202 |
| 1 | 51102 | DOWN | 218664_at | NM_016011 | 452 | NP_057095 | 1203 |
| 1 | 79570 | DOWN | 219438_at | NM_024522 | 453 | NP_078798 | 1204 |
| 1 | 57648 | DOWN | 212048_s_at | XM_036299 | 454 | XP_036299 | 1205 |
| 1 | 127544 | DOWN | 213038_at | NM_153341 | 455 | NP_699172 | 1206 |
| 1 | | DOWN | 212172_at | | 1501 | | — |
| 1 | 1912 | DOWN | 200919_at | NM_004427; NM_198040 | 456; 457 | NP_004418; NP_932157 | 1207; 1208 |
| 3 | 79188 | DOWN | 217795_s_at | NM_024334 | 459 | NP_077310 | 1210 |
| 3 | 7508 | DOWN | 209375_at | NM_004628 | 460 | NP_004619 | 1211 |
| 3 | 27258 | DOWN | 202209_at | NM_014463 | 461 | NP_055278 | 1212 |
| 4 | 5188 | DOWN | 204300_at | NM_004564 | 462 | NP_004555 | 1213 |
| 4 | 55294 | DOWN | 218751_s_at | NM_018315; NM_033632 | 463; 464 | NP_060785; NP_361014 | 1214; 1215 |
| 4 | 51809 | DOWN | 218313_s_at | NM_017423 | 465 | NP_059119 | 1216 |
| 4 | | DOWN | 210918_at | | 1502 | | 1503 |
| 4 | 9464 | DOWN | 220480_at | NM_021973 | 466 | NP_068808 | 1217 |
| 4 | 1635 | DOWN | 201571_s_at | NM_001921 | 467 | NP_001912 | 1218 |

TABLE 4-continued

Markers of the invention which reside in MCRs of deletion and display decreased expression.

| | | | | | | | |
|---|---|---|---|---|---|---|---|
| 4 | 55602 | DOWN | 218929_at | NM_017632 | 468 | NP_060102 | 1219 |
| 4 | 3660 | DOWN | 203275_at | NM_002199 | 469 | NP_002190 | 1220 |
| 4 | 55805 | DOWN | 207797_s_at | NM_018409 | 470 | NP_060879 | 1221 |
| 4 | 55325 | DOWN | 218449_at | NM_018359 | 471 | NP_060829 | 1222 |
| 5 | 51015 | DOWN | 218170_at | NM_016048 | 472 | NP_057132 | 1223 |
| 6 | 9474 | DOWN | 202511_s_at | NM_004849 | 473 | NP_004840 | 1224 |
| 6 | 55278 | DOWN | 218948_at | NM_018292 | 474 | NP_060762 | 1225 |
| 6 | 57107 | DOWN | 219307_at | NM_020381 | 475 | NP_065114 | 1226 |
| 6 | 11231 | DOWN | 201915_at | NM_007214 | 476 | NP_009145 | 1227 |
| 6 | 8724 | DOWN | 200067_x_at | NM_003795; NM_152827; NM_152828 | 477; 478; 479 | NP_003786; NP_690040; NP_690041 | 1228; 1229; 1230 |
| 6 | 8724 | DOWN | 213545_x_at | NM_003795; NM_152827; NM_152828 | 480; 481; 482 | NP_003786; NP_690040; NP_690041 | 1231; 1232; 1233 |
| 6 | | DOWN | 217185_s_at | | — | | — |
| 6 | 8763 | DOWN | 208654_s_at | NM_006016 | 483 | NP_006007 | 1234 |
| 6 | 6610 | DOWN | 214206_at | NM_003080 | 484 | NP_003071 | 1235 |
| 6 | 64780 | DOWN | 218376_s_at | NM_022765 | 485 | NP_073602 | 1236 |
| 6 | 9841 | DOWN | 205340_at | XM_376525 | 486 | XP_376525 | 1237 |
| 6 | 9896 | DOWN | 203656_at | NM_014845 | 487 | NP_055660 | 1238 |
| 6 | 8936 | DOWN | 204165_at | NM_003931 | 488 | NP_003922 | 1239 |
| 6 | 51362 | DOWN | 203377_s_at | NM_015891 | 489 | NP_056975 | 1240 |
| 6 | 23097 | DOWN | 212897_at | NM_015076 | 490 | NP_055891 | 1241 |
| 6 | 23097 | DOWN | 212899_at | NM_015076 | 491 | NP_055891 | 1242 |
| 6 | 262 | DOWN | 201196_s_at | NM_001634 | 492 | NP_001625 | 1243 |
| 6 | 5980 | DOWN | 208070_s_at | NM_002912 | 493 | NP_002903 | 1244 |
| 6 | 3066 | DOWN | 201833_at | NM_001527 | 494 | NP_001518 | 1245 |
| 6 | 7259 | DOWN | 221493_at | XM_371844 | 495 | XP_371844 | 1246 |
| 6 | 25842 | DOWN | 203427_at | NM_014034 | 496 | NP_054753 | 1247 |
| 6 | 10767 | DOWN | 209315_at | NM_006620 | 497 | NP_006611 | 1248 |
| 6 | 54806 | DOWN | 220841_s_at | NM_017651 | 498 | NP_060121 | 1249 |
| 6 | 4217 | DOWN | 203836_s_at | NM_005923 | 499 | NP_005914 | 1250 |
| 6 | 53832 | DOWN | 219115_s_at | NM_014432 | 500 | NP_055247 | 1251 |
| 6 | 23593 | DOWN | 203430_at | NM_014320 | 501 | NP_055135 | 1252 |
| 6 | 25901 | DOWN | 209479_at | NM_015439 | 502 | NP_056254 | 1253 |
| 6 | 51696 | DOWN | 218603_at | NM_016217 | 503 | NP_057301 | 1254 |
| 6 | 2911 | DOWN | 207299_s_at | NM_000838 | 504 | NP_000829 | 1255 |
| 6 | 55274 | DOWN | 221786_at | NM_018288; NM_133325 | 505; 506 | NP_060758: NP_579866 | 1256; 1257 |
| 6 | 55274 | DOWN | 219126_at | NM_018288; NM_133325 | 507; 508 | NP_060758; NP_579866 | 1258; 1259 |
| 8 | 9 | DOWN | 214440_at | NM_000662 | 509 | NP_000653 | 1260 |
| 8 | 55358 | DOWN | 218613_at | NM_018422 | 510 | NP_060892 | 1504 |
| 8 | 23362 | DOWN | 203354_s_at | NM_015310 | 511 | NP_056125 | 1261 |
| 8 | 526 | DOWM | 201089_at | NM_001693 | 512 | NP_001684 | 1262 |
| 8 | 2137 | DOWN | 209202_s_at | NM_001440 | 513 | NP_001431 | 1263 |
| 8 | 2137; 2137 | DOWN | 211051_s_at | NM_001440 | 514 | NP_001431 | 1264 |
| 8 | 55756 | DOWN | 203941_at | NM_018250 | 515 | NP_060720 | 1265 |
| 8 | 51669 | DOWN | 200847_s_at | NM_016127 | 516 | NP_057211 | 1266 |
| 8 | 23484 | DOWN | 202594_at | NM_015344 | 517 | NP_056159 | 1267 |
| 8 | 10671 | DOWN | 203261_at | NM_006571 | 518 | NP_006562 | 1268 |
| 8 | 11030 | DOWN | 207836_s_at | NM_006867 | 519 | NP_006858 | 1269 |
| 8 | 2961 | DOWN | 202680_at | NM_002095 | 520 | NP_002086 | 1270 |
| 8 | 2936 | DOWN | 205770_at | NM_000637 | 521 | NP_000628 | 1271 |
| 8 | 7993 | DOWN | 215983_s_at | NM_005671 | 522 | NP_005662 | 1272 |
| 8 | 5516 | DOWN | 201375_at | NM_004156 | 523 | NP_004147 | 1273 |
| 8 | 3084 | DOWN | 206237_s_at | NM_004495; NM_013956; NM_013957; NM_013958; NM_013959; NM_013960; NM_013961; NM_013962; NM_013964 | 524; 525; 526; 527; 528; 529; 530; 531; 532 | NP_004486; NP_039250; NP_039251; NP_039252; NP_039253; NP_039254; NP_039255; NP_039256; NP_039258 | 1274; 1275; 1276; 1277; 1278; 1279; 1280; 1281; 1282 |
| 8 | 84549; 84549 | DOWN | 211686_s_at | NM_032509 | 533 | NP_115898 | 1283 |
| 8 | 80185 | DOWN | 219124_at | NM_025115 | 534 | NP_079391 | 1284 |
| 8 | 11160; 11160 | DOWN | 221543_s_at | NM_007175; NM_007175 | 535; 536 | NP_009106 | 1285 |
| 8 | 11212 | DOWN | 214545_s_at | NM_007198 | 537 | NP_009129 | 1286 |
| 8 | | DOWN | 216416_at | | 1505 | | — |
| 9 | 6595 | DOWN | 212257_s_at | NM_003070; NM_139045 | 538; 539 | NP_003061; NP_620614 | 1287; 1288 |
| 9 | 7436 | DOWN | 209822_s_at | NM_003383 | 540 | NP_003374 | 1289 |
| 9 | 9933 | DOWN | 203712_at | NM_014878 | 541 | NP_055693 | 1290 |
| 9 | 55848 | DOWN | 218992_at | NM_018465 | 542 | NP_060935 | 1291 |

TABLE 4-continued

Markers of the invention which reside in MCRs of deletion and display decreased expression.

| | | | | | | | |
|---|---|---|---|---|---|---|---|
| 9 | 80380 | DOWN | 220049_s_at | NM_025239 | 543 | NP_079515 | 1292 |
| 9 | 26953 | DOWN | 213019_at | NM_012416 | 544 | XP_039701 | — |
| 9 | 4781 | DOWN | 213029_at | NM_005596 | 545 | NP_005587 | 1293 |
| 9 | 4781 | DOWN | 209289_at | NM_005596 | 546 | NP_005587 | 1294 |
| 9 | 6619 | DOWN | 204001_at | NM_003084 | 547 | NP_003075 | 1295 |
| 9 | 11168 | DOWN | 209337_at | NM_021144; NM_033222 | 548; 549 | NP_066967; NP_150091 | 1296; 1297 |
| 9 | 10670 | DOWN | 201628_s_at | NM_006570 | 550 | NP_006561 | 1298 |
| 9 | 54801 | DOWN | 218602_s_at | NM_017645 | 551 | NP_060115 | 1299 |
| 9 | 6194 | DOWN | 201254_x_at | NM_001010 | 552 | NP_001001 | 1300 |
| 9 | 54914 | DOWN | 218503_at | NM_017794 | 553 | NP_060264 | 1301 |
| 9 | 55958 | DOWN | 213233_s_at | NM_018847 | 554 | NP_061335 | 1302 |
| 9 | 1029 | DOWN | 207039_at | NM_000077; NM_058195; NM_058196; NM_058197 | 556; 557; 558; 559 | NP_000068; NP_478102; NP_478103; NP_478104 | 1304; 1305; 1306 |
| 9 | 4507 | DOWN | 211363_s_at | NM_002451 | 560 | NP_002442 | 1307 |
| 12 | 5756; 5756 | DOWN | 201745_at | NM_002822; NM_198974; NM_002822; NM_198974 | 561; 562; 563; 564 | NP_002813; NP_945325 | 1308; 1309 |
| 12 | 51054 | DOWN | 220157_x_at | NM_015899 | 565 | NP_056983 | 1310 |
| 12 | 9169 | DOWN | 206989_s_at | NM_004719 | 566 | NP_004710 | 1311 |
| 12 | 55652 | DOWN | 218417_s_at | NM_017842 | 567 | NP_060312 | 1312 |
| 12 | 7421 | DOWN | 204255_s_at | NM_000376 | 568 | NP_000367 | 1313 |
| 12 | 54934 | DOWN | 221821_s_at | NM_017822 | 569 | NP_060292 | 1314 |
| 12 | 784 | DOWN | 209530_at | NM_000725 | 570 | NP_000716 | 1315 |
| 12 | 784 | DOWN | 34726_at | NM_000725 | 571 | NP_000716 | 1316 |
| 12 | 9416 | DOWN | 40465_at | NM_004818 | 572 | NP_004809 | 1317 |
| 12 | 51303 | DOWN | 219117_s_at | NM_016594 | 573 | NP_057678 | 1318 |
| 12 | 377 | DOWN | 200011_s_at | NM_001659 | 574 | NP_001650 | 1319 |
| 12 | 377; 377 | DOWN | 211622_s_at | NM_001659 | 575 | NP_001650 | 1320 |
| 12 | 5571 | DOWN | 201805_at | NM_002733 | 576 | NP_002724 | 1321 |
| 12 | 55716 | DOWN | 220036_s_at | NM_018113 | 577 | NP_060583 | 1322 |
| 12 | 65244 | DOWN | 218324_s_at | NM_023071 | 578 | NP_075559 | 1323 |
| 12 | 10445 | DOWN | 202556_s_at | NM_006337 | 579 | NP_006328 | 1324 |
| 12 | 7009 | DOWN | 200803_s_at | NM_003217 | 580 | NP_003208 | 1325 |
| 12 | 29127 | DOWN | 222077_s_at | NM_013277 | 581 | NP_037409 | 1326 |
| 12 | 4891 | DOWN | 203123_s_at | NM_000617 | 582 | NP_000608 | 1327 |
| 12 | 7024 | DOWN | 207627_s_at | NM_005653 | 583 | NP_005644 | 1328 |
| 12 | 9802 | DOWN | 200794_x_at | NM_014764 | 584 | NP_055579 | 1329 |
| 12 | 57228 | DOWN | 209679_s_at | NM_020467 | 585 | NP_065200 | 1330 |
| 12 | 91 | DOWN | 205209_at | NM_004302; NM_020327; NM_020328 | 587; 588; 589 | NP_004293; NP_064732; NP_064733 | 1332; 1333; 1334 |
| 12 | 91 | DOWN | 213198_at | NM_004302; NM_020327; NM_020328 | 590; 591; 592 | NP_004293; NP_064732; NP_064733 | 1335; 1336; 1337 |
| 12 | | DOWN | 222304_x_at | | 1506 | | — |
| 12 | 1975 | DOWN | 211937_at | NM_001417 | 593 | NP_001408 | 1338 |
| 12 | 5916 | DOWN | 217178_at | NM_000966 | 594 | NP_000957 | 1339 |
| 12 | 84975 | DOWN | 212861_at | NM_032889 | 595 | NP_116278 | 1340 |
| 12 | 5204 | DOWN | 207132_x_at | NM_002624; NM_145896; NM_145897 | 596; 597; 598 | NP_002615; NP_665903; NP_665904 | 1341; 1342; 1343 |
| 12 | 60314 | DOWN | 218220_at | NM_021640 | 599 | NP_067653 | 1344 |
| 12 | 3227 | DOWN | 206745_at | NM_014212 | 600 | NP_055027 | 1345 |
| 12 | 3223 | DOWN | 206194_at | NM_004503; NM_153693 | 601; 602 | NP_004494; NP_710160 | 1346; 1347 |
| 12 | 23583 | DOWN | 218685_s_at | NM_014311 | 603 | NP_055126 | 1348 |
| 12 | | DOWN | 212126_at | | 1507 | | — |
| 12 | 3178 | DOWN | 200016_x_at | NM_002136; NM_031157 | 604; 605 | NP_002127; NP_112420 | 1349; 1350 |
| 12 | 22818 | DOWN | 217726_at | NM_016057 | 606 | NP_057141 | 1351 |
| 12 | 2647 | DOWN | 202592_at | NM_001487 | 607 | NP_001478 | 1352 |
| 12 | 967 | DOWN | 200663_at | NM_001780 | 608 | NP_001771 | 1353 |
| 12 | 29095 | DOWN | 218556_at | NM_014182 | 609 | NP_054901 | 1354 |
| 12 | 11260 | DOWN | 212160_at | NM_007235 | 614 | NP_009166 | 1359 |
| 12 | 29110 | DOWN | 218520_at | NM_013254 | 615 | NP_037386 | 1360 |
| 12 | 2799 | DOWN | 212334_at | NM_002076 | 616 | NP_002067 | 1361 |
| 12 | 2799 | DOWN | 203676_at | NM_002076 | 617 | NP_002067 | 1362 |
| 12 | 23592 | DOWN | 218604_at | NM_014319 | 618 | NP_055134 | 1363 |
| 12 | 51643 | DOWN | 219206_x_at | NM_016056 | 619 | NP_057140 | 1364 |
| 12 | 55832 | DOWN | 207483_s_at | NM_018448 | 620 | NP_060918 | 1365 |
| 12 | 55832 | DOWN | 208838_at | NM_018448 | 621 | NP_060918 | 1366 |
| 12 | 8445 | DOWN | 202968_s_at | NM_003583; NM_006482 | 622; 623 | NP_003574; NP_006473 | 1367; 1368 |
| 12 | 5908 | DOWN | 200833_s_at | NM_015646 | 624 | NP_056461 | 1369 |

TABLE 4-continued

Markers of the invention which reside in MCRs of deletion and display decreased expression.

| | | | | | | | |
|---|---|---|---|---|---|---|---|
| 12 | 55508 | DOWN | 218988_at | NM_018656 | 625 | NP_061126 | 1370 |
| 12 | 8089 | DOWN | 218911_at | NM_006530 | 626 | NP_006521 | 1371 |
| 12 | 10576 | DOWN | 201947_s_at | NM_006431 | 627 | NP_006422 | 1372 |
| 12 | 4659 | DOWN | 201603_at | NM_002480 | 628 | NP_002471 | 1373 |
| 12 | 29080 | DOWN | 218936_s_at | NM_014167 | 629 | NP_054886 | 1374 |
| 12 | 91298 | DOWN | 213701_at | | 1508 | | — |
| 12 | 80184 | DOWN | 221683_s_at | NM_025114 | 630 | NP_079390 | 1375 |
| 12 | 4254 | DOWN | 207029_at | NM_000899; NM_003994 | 631; 632 | NP_000890; NP_003985 | 1376; 1377 |
| 12 | 1848 | DOWN | 208891_at | NM_001946; NM_022652 | 633; 634 | NP_001937; NP_073143 | 1378; 1379 |
| 12 | 490 | DOWN | 212930_at | NM_001682 | 635 | NP_001673 | 1380 |
| 12 | 490 | DOWN | 209281_s_at | NM_001682 | 636 | NP_001673 | 1381 |
| 12 | 694 | DOWN | 200921_s_at | NM_001731 | 637 | NP_001722 | 1382 |
| 16 | 527 | DOWN | 200954_at | NM_001694 | 638 | NP_001685 | 1383 |
| 16 | 527 | DOWN | 36994_at | NM_001694 | 639 | NP_001685 | 1384 |
| 16 | 51005 | DOWN | 219082_at | NM_015944 | 640 | NP_057028 | 1385 |
| 16 | 5170 | DOWN | 204524_at | NM_002613 | 641 | NP_002604 | 1386 |
| 16 | 5170 | DOWN | 32029_at | NM_002613 | 642 | NP_002604 | 1387 |
| 16 | 23524 | DOWN | 208610_s_at | NM_016333 | 643 | NP_057417 | 1388 |
| 16 | 23524 | DOWN | 213877_x_at | NM_016333 | 644 | NP_057417 | 1389 |
| 17 | 9570 | DOWN | 210009_s_at | NM_004287; NM_054022 | 233; 234 | NP_004278; NP_473363 | 984; 985 |
| 18 | 5289 | DOWN | 204297_at | NM_002647 | 645 | NP_002638 | 1390 |
| 18 | 498 | DOWN | 213738_s_at | NM_004046 | 646 | NP_004037 | 1391 |
| 18 | 9063 | DOWN | 214593_at | NM_004671; NM_173206 | 647; 648 | NP_004662; NP_775298 | 1392; 1393 |
| 18 | 9063 | DOWN | 37433_at | NM_004671; NM_173206 | 649; 650 | NP_004662; NP_775298 | 1394; 1395 |
| 18 | 51124 | DOWN | 211406_at | NM_016097 | 651 | NP_057181; NP_060992 | 1396 |
| 18 | 9306 | DOWN | 214462_at | NM_004232 | 652 | NP_004223 | 1397 |
| 18 | 4155 | DOWN | 207323_s_at | NM_002385 | 653 | NP_002376 | 1398 |
| 18 | 4772 | DOWN | 210161_at | NM_006162; NM_172387; NM_172388; NM_172389; NM_172390 | 654; 655; 666; 657; 658 | NP_006153; NP_765975; NP_765976; NP_765977; NP_765978 | 1399; 1400; 1401; 1402; 1403 |
| 38 | 9150 | DOWN | 205035_at | NM_004715; NM_048368 | 659; 660 | NP_004706; NP_430255 | 1404; 1405 |
| 18 | 80148 | DOWN | 218208_at | NM_025078 | 661 | NP_079354 | 1406 |
| 18 | 10907 | DOWN | 202835_at | NM_006701 | 662 | NP_006692 | 1407 |
| 18 | 79863 | DOWN | 219419_at | NM_024805 | 663 | NP_079081 | 1408 |
| 18 | 22850 | DOWN | 203321_s_at | XM_377498 | 664 | XP_377498 | 1409 |
| 19 | 5536 | DOWN | 201979_s_at | NM_006247 | 319 | NP_006238 | 1070 |
| 19 | 26121 | DOWN | 202408_s_at | NM_015629 | 370 | NP_056444 | 1121 |
| 19 | 3802 | DOWN | 210890_x_at | NM_014218 | 665 | NP_055033 | 1410 |
| 19 | 9437 | DOWN | 207860_at | NM_004829 | 666 | NP_004820 | 1411 |
| 21 | 6612 | DOWN | 200740_s_at | NM_006936 | 667 | NP_008867 | 1412 |
| 21 | 754 | DOWN | 200677_at | NM_004339 | 668 | NP_004330 | 1413 |
| 21 | 3275 | DOWN | 202098_s_at | NM_001535 | 669 | NP_001526 | 1414 |
| 22 | 25812 | DOWN | 214570_x_at | NM_014348 | 670 | NP_055163 | 1415 |
| 22 | 28831 | DOWN | 216846_at | | 1509 | | 1510 |
| 22 | 9609 | DOWN | 211471_s_at | NM_004914 | 671 | NP_004905 | 1416 |
| 22 | 613 | DOWN | 202315_s_at | NM_004327; NM_021574 | 672; 673 | NP_004318; NP_067585 | 1417; 1418 |
| 22 | 3543 | DOWN | 206660_at | NM_020070; NM_152855 | 674; 675 | NP_064455; NP_690594 | 1419; 1420 |
| 22 | 375159 | DOWN | 215816_at | | 1511 | | 1512 |
| 22 | 4320 | DOWN | 203876_s_at | NM_005940 | 676 | NP_005931 | 1421 |
| 22 | 6598 | DOWN | 206532_at | NM_003073 | 677 | NP_003064 | 1422 |
| 22 | 2952 | DOWN | 203815_at | NM_000853 | 678 | NP_000844 | 1423 |
| 22 | 6634 | DOWN | 202567_at | NM_004175 | 679 | NP_004166 | 1424 |
| 22 | 89781 | DOWN | 54037_at | NM_022081; NM_152840; NM_152841; NM_152842; NM_152843 | 680; 681; 682; 683; 684 | NP_071364; NP_690053; NP_690054; NP_690055; NP_690056 | 1425; 1426; 1427; 1428; 1429 |
| 22 | 89781 | DOWN | 218402_s_at | NM_022081; NM_152840; NM_152841; NM_152842; NM_152843 | 685; 686; 687; 688; 689 | NP_071364; NP_690053; NP_690054; NP_690055; NP_690056 | 1430; 1431; 1432; 1433; 1434 |
| 22 | 24144 | DOWN | 202750_s_at | NM_012143 | 690 | NP_036275 | 1435 |
| 22 | 1413 | DOWN | 206843_at | NM_001886 | 691 | NP_001877 | 1436 |
| 22 | 4330 | DOWN | 205330_at | NM_002430 | 692 | NP_002421 | 1437 |
| 22 | 11200 | DOWN | 210416_s_at | NM_007194; NM_145862 | 693; 694; | NP_009125; NP_665861 | 1438; 1439 |

TABLE 4-continued

Markers of the invention which reside in MCRs of deletion and display decreased expression.

| | | | | | | | |
|---|---|---|---|---|---|---|---|
| 22 | 8563 | DOWN | 209418_s_at | | 1513 | | 1514 |
| 22 | 84164 | DOWN | 215684_s_at | NM_032204 | 695 | NP_115580 | 1440 |
| 22 | 10291 | DOWN | 201357_s_at | NM_005877 | 696 | NP_005868 | 1441 |
| 22 | 23541 | DOWN | 204541_at | NM_012429 | 697 | NP_036561 | 1442 |
| 22 | 23598 | DOWN | 209431_s_at | NM_014323; NM_032050; NM_032051; NM_032052 | 698; 699; 700; 701 | NP_055138; NP_114439; NP_114440; NP_114441 | 1443; 1444; 1445; 1446 |
| 22 | 9814 | DOWN | 213431_x_at | XM_038520 | 702 | XP_038520 | 1447 |
| 22 | 9814 | DOWN | 36545_s_at | XM_038520 | 703 | XP_038520 | 1448 |
| 22 | 23761 | DOWN | 202392_s_at | NM_014338 | 704 | NP_055153 | 1449 |
| 22 | 9814 | DOWN | 215699_x_at | XM_038520 | 705 | XP_038520 | 1450 |
| 22 | 9681 | DOWN | 205223_at | XM_377498 | 706 | XP_376007 | 1451 |
| 22 | 7533 | DOWN | 201020_at | NM_003405 | 707 | NP_003396 | 1452 |
| 22 | | DOWN | 215762_at | | 1515 | | — |
| 22 | 7078 | DOWN | 201149_s_at | NM_000362 | 708 | NP_000353 | 1453 |
| 22 | 10043 | DOWN | 202807_s_at | NM_005488 | 709 | NP_005479 | 1454 |
| 22 | 80830 | DOWN | 219716_at | NM_030641 | 710 | NP_085144 | 1455 |
| 22 | 23543 | DOWN | 212104_s_at | NM_014309 | 711 | NP_055124 | 1456 |
| 22 | 80833 | DOWN | 221087_s_at | NM_014349; NM_030644; NM_145639; NM_145640; NM_145641; NM_145642 | 712; 713; 714; 715; 716; 717 | NP_055164; NP_085147; NP_663614; NP_663615; NP_663616; NP_663617 | 1457; 1458; 1459; 1460; 1461; 1462 |
| 22 | 23780 | DOWN | 221653_x_at | NM_030882; NM_145637 | 718; 719 | NP_112092; NP_663612 | 1463; 1464 |
| 22 | 4627 | DOWN | 211926_s_at | NM_002473 | 720 | NP_002464 | 1465 |
| 22 | 25828 | DOWN | 209077_at | NM_012473 | 721 | NP_036605 | 1466 |
| 22 | 25828 | DOWN | 209078_s_at | NM_012473 | 722 | NP_036605 | 1467 |
| 22 | 8664 | DOWN | 200005_at | NM_003753 | 723 | NP_003744 | 1468 |
| 22 | 7263 | DOWN | 209605_at | NM_003312 | 724 | NP_003303 | 1469 |
| 22 | 4357 | DOWN | 203524_s_at | NM_021126 | 725 | NP_066949 | 1470 |
| 22 | 79734 | DOWN | 205561_at | NM_024681 | 726 | NP_078957 | 1471 |
| 22 | 4242 | DOWN | 213783_at | NM_002405 | 727 | NP_002396 | 1472 |
| 22 | 29775 | DOWN | 214207_s_at | NM_014550 | 728 | NP_055365 | 1473 |
| 22 | 26088 | DOWN | 218114_at | NM_013365 | 729 | NP_037497 | 1474 |
| 22 | 26088 | DOWN | 45572_s_at | NM_013365 | 730 | NP_037497 | 1475 |
| 22 | 23616 | DOWN | 213633_at | NM_018957 | 731 | NP_061830 | 1476 |
| 22 | 23464 | DOWN | 205164_at | NM_014291 | 732 | NP_055106 | 1477 |
| 22 | 5435 | DOWN | 209511_at | NM_021974 | 733 | NP_068809 | 1478 |
| 22 | 1454 | DOWN | 222015_at | NM_001894; NM_152221 | 734; 735 | NP_001885; NP_689407 | 1479; 1480 |
| 22 | 11015 | DOWN | 204017_at | NM_006855; NM_016657 | 736; 737 | NP_006846; NP_057839 | 1481; 1482 |
| 22 | 11144 | DOWN | 208382_s_at | NM_007068 | 738 | NP_008999 | 1483 |
| 22 | 25776 | DOWN | 203450_at | NM_015373 | 739 | NP_056188 | 1484 |
| 22 | 56993 | DOWN | 217960_s_at | NM_020243 | 740 | NP_064628 | 1485 |
| 22 | 9929 | DOWN | 201751_at | NM_014876 | 741 | NP_055691 | 1486 |
| 22 | 25777 | DOWN | 212144_at | NM_015374 | 742 | NP_056189 | 1487 |
| 22 | 9567 | DOWN | 205274_at | NM_004286; | 743 | NP_004277; NP_054746 | 1488 |
| 22 | 9567 | DOWN | 219357_at | NM_004286; | 744 | NP_004277; NP_054746 | 1489 |
| 22 | 5155 | DOWN | 216061_x_at | NM_002608; NM_033016 | 745; 746 | NP_002599; NP_148937 | 1490; 1491 |
| 22 | 10454 | DOWN | 203901_at | NM_006116; NM_153497 | 747; 748 | NP_006107; NP_705717 | 1492; 1493 |
| 22 | 4248 | DOWN | 208058_s_at | NM_002409 | 749 | NP_002400 | 1494 |
| 22 | 54471 | DOWN | 221516_s_at | NM_019008 | 750 | NP_061881 | 1495 |
| 22 | 54471 | DOWN | 204593_s_at | NM_019008 | 751 | NP_061881 | 1496 |
| 22 | 468 | DOWN | 200779_at | NM_001675; NM_182810 | 752; 753 | NP_001666; NP_877962 | 1497; 1498 |
| 22 | 4248 | DOWN | 209764_at | NM_002409 | 754 | NP_002400 | 1499 |
| 22 | 27352 | DOWN | 203014_x_at | NM_015705 | 755 | NP_056520 | 1500 |

TABLE 5

Markers of the invention which reside in MCRs of amplification and display increased expression.

| Chromosome | Pos (Mb) | Gene Weight | Minimum p value | Gene Description | Gene Symbol | GI | UGID# |
|---|---|---|---|---|---|---|---|
| 1 | 26.8 | 1.03 | 0.032 | nuclear distribution gene C homolog (A. nidulans) | NUDC | gi: 5729952 | Hs.263812 |

TABLE 5-continued

Markers of the invention which reside in MCRs of amplification and display increased expression.

| | | | | | | | |
|---|---|---|---|---|---|---|---|
| 1 | 116.9 | 2.41 | 0.038 | transcription termination factor, RNA polymerase II | TTF2 | gi: 5733121 | Hs.201774 |
| 1 | 117.8 | 0.85 | 0.029 | WD repeat domain 3 | WDR3 | gi: 5803220 | Hs.201375 |
| 2 | 11.3 | 0.06 | 0.035 | hypothetical protein MGC33602 | MGC33602 | gi: 7328008 | Hs.274415 |
| 5 | 0.2 | 0.69 | <.005 | succinate dehydrogenase complex, subunit A, flavoprotein (Fp) | SDHA | gi: 4759079 | Hs.440475 |
| 5 | 0.3 | 0.85 | <.005 | programmed cell death 6 | PDCD6 | gi: 7019484 | Hs.24087 |
| 5 | 0.5 | 0.95 | <.005 | Sec 6 (*S. cerevisiae*) homolog | SEC6 | gi: 3005726 | Hs.448580 |
| 5 | 0.6 | 0.58 | 0.005 | hypothetical protein FLJ10565 | FLJ10565 | gi: 8922520 | Hs.100824 |
| 5 | 0.9 | 0.77 | <.005 | hypothetical protein FLJ13441 | FLJ13441 | gi: 12965190 | Hs.449178 |
| 5 | 1.5 | 0.60 | 0.014 | hypothetical protein FLJ12443 | FLJ12443 | gi: 13376233 | Hs.179882 |
| 5 | 1.8 | 0.96 | <.005 | NADH dehydrogenase (ubiquinone) Fe—S protein 6, 13 kDa (NADH-coenzyme Q reductase) | NDUFS6 | gi: 4758791 | Hs.408257 |
| 5 | 5.5 | 0.72 | 0.005 | KIAA0947 protein | KIAA0947 | gi: 13436178 | Hs.5070 |
| 6 | 32 | 0.67 | 0.032 | tenascin XB | TNXB | gi: 8361667 | Hs.411644 |
| 6 | 42.9 | 1.03 | <.005 | trinucleotide repeat containing 5 | TNRC5 | gi: 13325207 | Hs.414099 |
| 6 | 43 | 0.25 | 0.005 | protein phosphatase 2, regulatory subunit B (B56), delta isoform | PPP2R5D | gi: 5453953 | Hs.118244 |
| 7 | 0.8 | 0.47 | 0.017 | G protein-coupled receptor 30 | GPR30 | gi: 1381668 | Hs.113207 |
| 7 | 1.2 | 0.56 | <.005 | G protein-coupled receptor 30 | GPR30 | gi: 2656120 | Hs.113207 |
| 7 | 1.2 | 0.14 | <.005 | DKFZP586J0619 protein | DKFZP586J0619 | gi: 10809392 | Hs.112184 |
| 7 | 1.5 | 0.64 | <.005 | MICAL-like 2 | FLJ23471 | gi: 13376030 | Hs.376617 |
| 7 | 1.6 | 0.40 | 0.026 | v-maf musculoaponeurotic fibrosarcoma oncogene homolog K (avian) | MAFK | gi: 4505074 | Hs.131953 |
| 7 | 2.1 | 0.95 | <.005 | MAD1 mitotic arrest deficient-like 1 (yeast) | MAD1L1 | gi: 4505064 | Hs.7345 |
| 7 | 30.7 | 0.47 | 0.027 | glycyl-tRNA synthetase | GARS | gi: 577711 | Hs.293885 |
| 7 | 64.9 | 1.19 | 0.008 | argininosuccinate lyase | ASL | gi: 4502256 | Hs.442047 |
| 7 | 65 | 0.87 | 0.02 | calcitonin gene-related peptide-receptor component protein | RCP9 | gi: 7656976 | Hs.300684 |
| 7 | 65.5 | 1.17 | <.005 | potassium channel tetramerisation domain containing 7 | KCTD7 | gi: 5596067 | Hs.119683 |
| 7 | 65.6 | 1.04 | <.005 | RAB guanine nucleotide exchange factor (GEF) 1 | RABGEF1 | gi: 7657495 | Hs.187660 |
| 7 | 65.8 | 1.42 | <.005 | hypothetical protein FLJ10099 | FLJ10099 | gi: 8922228 | Hs.287955 |
| 7 | 93.2 | 0.69 | <.005 | BET1 homolog (*S. cerevisiae*) | BET1 | gi: 12654162 | Hs.23103 |
| 7 | 93.7 | 0.37 | 0.05 | O-acetyltransferase | CAS1 | gi: 12597638 | Hs.324725 |
| 7 | 94.6 | 0.43 | 0.032 | paraoxonase 3 | PON3 | gi: 1333633 | Hs.440967 |
| 7 | 94.6 | 1.07 | <.005 | paraoxonase 2 | PON2 | gi: 2228776 | Hs.165598 |
| 7 | 94.8 | 0.50 | 0.015 | pyruvate dehydrogenase kinase, isoenzyme 4 | PDK4 | gi: 4505692 | Hs.8364 |
| 7 | 95.4 | 0.57 | 0.017 | solute carrier family 25, member 13 (citrin) | SLC25A13 | gi: 7657580 | Hs.9599 |
| 7 | 95.9 | 1.01 | <.005 | split hand/foot malformation (ectrodactyly) type 1 | SHFM1 | gi: 5453639 | Hs.333495 |
| 7 | 96.3 | 0.42 | 0.045 | ACN9 homolog (*S. cerevisiae*) | ACN9 | gi: 9910179 | Hs.42785 |
| 7 | 97.1 | 0.77 | <.005 | asparagine synthetase | ASNS | gi: 4502258 | Hs.446546 |
| 7 | 97.2 | 1.23 | <.005 | *Homo sapiens* transcribed sequence with weak similarity to protein pir: PC4369 (*H. sapiens*) PC4369 olfactory receptor. HT2 - human (fragment) | | gi: 8008445 | Hs.512431 |
| 7 | 97.3 | 0.89 | <.005 | kinase phosphatase inhibitor 2 | KPI2 | gi: 7662475 | Hs.122708 |
| 7 | 98.1 | 0.94 | <.005 | transformation/transcription domain-associated protein | TRRAP | gi: 4507690 | Hs.203952 |
| 7 | 98.2 | 0.66 | <.005 | E3 ubiquitin ligase SMURF1 | SMURF1 | gi: 4738848 | Hs.436249 |
| 7 | 98.2 | 0.70 | <.005 | transformation/transcription domain-associated protein | TRRAP | gi: 3694662 | Hs.203952 |
| 7 | 98.2 | 0.58 | 0.02 | E3 ubiquitin ligase SMURF1 | SMURF1 | gi: 6446605 | Hs.436249 |
| 7 | 98.2 | 0.63 | 0.005 | *Homo sapiens* cDNA: FLJ21284 fis, clone COL01911 | | gi: 10437358 | Hs.288218 |
| 7 | 98.5 | 0.49 | 0.013 | *Homo sapiens* clone 24438 mRNA sequence | | gi: 3283921 | Hs.124126 |
| 7 | 98.5 | 0.99 | <.005 | actin related protein 2/3 complex, subunit 1A, 41 kDa | ARPC1A | gi: 5454077 | Hs.291981 |
| 7 | 98.5 | 1.01 | | actin related protein 2/3 complex, subunit 1B, 41 kDa | ARPC1B | gi: 5031600 | Hs.433506 |
| 7 | 98.7 | 0.76 | <.005 | zinc finger protein 95 homolog (mouse) | ZFP95 | gi: 11036641 | Hs.110839 |
| 7 | 98.8 | 0.60 | 0.005 | cytochrome P450, family 3, subfamily A, polypeptide 5 | CYP3A5 | gi: 945005 | Hs.150276 |
| 7 | 98.8 | 0.67 | <.005 | cytochrome P450, family 3, subfamily A, polypeptide 5 | CYP3A5 | gi: 4503230 | Hs.150276 |
| 7 | 99.3 | 0.59 | 0.014 | adaptor-related protein complex 4, mu 1 subunit | AP4M1 | gi: 5442365 | Hs.194703 |
| 7 | 99.3 | 0.98 | <.005 | TAF6 RNA polymerase II, TATA box binding protein (TBP)-associated factor, 80 kDa | TAF6 | gi: 5032146 | Hs.289950 |
| 7 | 99.5 | 0.38 | 0.035 | postmeiotic segregation increased 2-like 6 | PMS2L6 | gi: 4175684 | Hs.367667 |
| 7 | 99.8 | 0.94 | 0.05 | guanine nucleotide binding protein (G protein), beta polypeptide 2 | GNB2 | gi: 4885282 | Hs.185172 |
| 7 | 100 | 0.67 | 0.005 | solute carrier family 12 (potassium/chloride transporters), member 9 | SLC12A9 | gi: 9910385 | Hs.437628 |

TABLE 5-continued

Markers of the invention which reside in MCRs of amplification and display increased expression.

| | | | | | | |
|---|---|---|---|---|---|---|
| 7 | 100.4 | 0.94 | <.005 | procollagen-lysine, 2-oxoglutarate 5-dioxygenase 3 | PLOD3 | gi: 4505890 Hs.153357 |
| 7 | 100.4 | 0.50 | 0.018 | zinc finger, HIT domain containing 1 | ZNHIT1 | gi: 5453616 Hs.211079 |
| 7 | 100.4 | 0.36 | 0.044 | tetratricopeptide repeat domain 11 | TTC11 | gi: 7705631 Hs.423968 |
| 7 | 100.8 | 0.36 | 0.047 | myosin light chain 2, precursor lymphocyte-specific | MYLC2PL | gi: 12803868 Hs.247831 |
| 7 | 101.6 | 0.35 | 0.007 | chromosome 7 open reading frame 19 | C7orf19 | gi: 12357031 Hs.289053 |
| 7 | 101.6 | 0.49 | 0.02 | HSPC047 protein | HSPC047 | gi: 7661749 Hs.512142 |
| 7 | 101.6 | 0.36 | 0.05 | polymerase (RNA) II (DNA directed) polypeptide J, 13.3 kDa | POLR2J | gi: 5100572 Hs.489461 |
| 7 | 101.7 | 0.38 | 0.038 | DNA directed RNA polymerase II polypeptide J-related gene | POLR2J2 | gi: 10036750 Hs.406505 |
| 7 | 101.7 | 0.48 | <.005 | DNA directed RNA polymerase II polypeptide J-related gene | POLR2J2 | gi: 5901957 Hs.406505 |
| 7 | 105 | 0.84 | <.005 | hypothetical protein MGC33190 | MGC33190 | gi: 3231718 Hs.211068 |
| 7 | 105.3 | 0.36 | 0.03 | synaptophysin-like protein | SYPL | gi: 5235354 Hs.80919 |
| 7 | 106.8 | 0.76 | 0.048 | solute carrier family 26, member 4 | SLC26A4 | gi: 4505696 Hs.512611 |
| 7 | 106.9 | 0.48 | 0.041 | Cas-Br-M (murine) ecotropic retroviral transforming sequence-like 1 | CBLL1 | gi: 13376203 Hs.458382 |
| 7 | 107.1 | 0.69 | 0.01 | dihydrolipoamide dehydrogenase (E3 component of pyruvate dehydrogenase complex, 2-oxo-glutarate complex, branched chain keto acid dehydrogenase complex) | DLD | gi: 181574 Hs.74635 |
| 7 | 111.1 | 0.50 | 0.017 | dedicator of cytokinesis 4 | DOCK4 | gi: 7662263 Hs.118140 |
| 8 | 37.7 | 0.60 | 0.037 | G protein-coupled receptor 124 | GPR124 | gi: 11594613 Hs.17270 |
| 8 | 37.7 | 0.72 | 0.029 | G protein-coupled receptor 124 | GPR124 | gi: 4739882 Hs.17270 |
| 8 | 37.7 | 1.12 | <.005 | BRF2, subunit of RNA polymerase III transcription initiation factor, BRF1-like | BRF2 | gi: 11096174 Hs.274136 |
| 8 | 37.9 | 0.56 | 0.008 | ash2 (absent, small, or homeotic)-like (*Drosophila*) | ASH2L | gi: 4417209 Hs.6856 |
| 8 | 38 | 0.66 | 0.005 | LSM1 homolog, U6 small nuclear RNA associated (*S. cerevisiae*) | LSM1 | gi: 7657312 Hs.425311 |
| 8 | 38 | 0.39 | 0.046 | BCL2-associated athanogene 4 | BAG4 | gi: 6631074 Hs.194726 |
| 8 | 38.1 | 0.83 | <.005 | KIAA0725 protein | KIAA0725 | gi: 3882170 Hs.434966 |
| 8 | 38.2 | 0.46 | 0.039 | Wolf-Hirschhorn syndrome candidate 1-like 1 | WHSC1L1 | gi: 13699812 Hs.415895 |
| 8 | 120.7 | 0.43 | 0.026 | TAP2 RNA polmerase II, TATA box binding protein (TBP)-associated factor, 150 kDa | TAF2 | gi: 7022983 Hs.122752 |
| 8 | 121.3 | 0.38 | 0.042 | mitochondrial ribosomal protein L13 | MRPL13 | gi: 7662495 Hs.333823 |
| 8 | 122.5 | 0.43 | 0.03 | hysturonan synthase 2 | HAS2 | gi: 4885390 Hs.159226 |
| 8 | 123.9 | 0.48 | 0.014 | hypothetical protein MGC3067 | MGC3067 | gi: 8924181 Hs.241576 |
| 8 | 123.9 | 0.37 | 0.05 | hypothetical protein MGC3067 | MGC3067 | gi: 13236515 Hs.241576 |
| 8 | 124.1 | 0.44 | 0.021 | unknown MGC21654 product | MGC21654 | gi: 3231900 Hs.95631 |
| 8 | 124.3 | 0.55 | 0.008 | hypothetical protein FLJ10204 | FLJ10204 | gi: 8922280 Hs.18029 |
| 8 | 124.6 | 0.52 | 0.012 | annexin A13 | ANXA13 | gi: 4757753 Hs.181107 |
| 8 | 125.4 | 1.03 | <.005 | ring finger 139 | RNF139 | gi: 3395786 Hs.228285 |
| 8 | 125.9 | 0.66 | <.005 | KIAA0196 gene product | KIAA0196 | gi: 7661987 Hs.437991 |
| 8 | 128.7 | 0.62 | 0.012 | v-myc myelocytomatosis viral oncogene homolog (avian) | MYC | gi: 12962934 Hs.202453 |
| 8 | 128.9 | 0.62 | 0.017 | Homo sapiens cDNA FLJ26234 fis, clone ADG09627 | | gi: 190753 Hs.459222 |
| 8 | 130.8 | 0.59 | 0.013 | hypothetical protein BM-009 | BM-009 | gi: 7705303 Hs.369973 |
| 8 | 133.7 | 0.43 | 0.022 | CGI-72 protein | CGI-72 | gi: 7705782 Hs.44159 |
| 8 | 134.2 | 0.47 | 0.023 | N-myc downstream regulated gene 1 | NDRG1 | gi: 5174656 Hs.318567 |
| 8 | 141.8 | 0.37 | 0.048 | PTK2 protein tyrosine kinase 2 | PTK2 | gi: 5406748 Hs.434281 |
| 8 | 143.8 | 0.41 | 0.034 | mescochymal stem cell protein DSCD75 | LOC51337 | gi: 7706199 Hs.25237 |
| 8 | 144.6 | 0.59 | 0.009 | KIAA0150 protein | KIAA0150 | gi: 1469881 Hs.370491 |
| 8 | 144.7 | 0.37 | 0.037 | hypothetical protein FLJ12150 | FLJ12150 | gi: 13376057 Hs.118983 |
| 8 | 144.7 | 0.37 | 0.032 | eukaryotic translation elongation factor 1 delta (guanine nucleotide exchange protein) | EEF1D | gi: 4622550 Hs.334798 |
| 8 | 144.8 | 0.73 | <.005 | tissue specific transplantation antigen P35B | TSTA3 | gi: 6598326 Hs.404119 |
| 8 | 144.8 | 0.80 | <.005 | tissue specific transplantation antigen P35B | TSTA3 | gi: 1381178 Hs.404119 |
| 8 | 144.8 | 0.61 | 0.01 | KIAA0628 gene product | KIAA0628 | gi: 7662213 Hs.43133 |
| 8 | 144.9 | 0.46 | 0.022 | scribble | SCRIB | gi: 4331493 Hs.436329 |
| 8 | 145.2 | 0.61 | <.005 | 5-oxoprolinase (ATP-hydrolysing) | OPLAH | gi: 5838792 Hs.305882 |
| 8 | 145.2 | 0.49 | 0.014 | exosome complex exonuclease RRP41 | RRP41 | gi: 4534672 Hs.343589 |
| 8 | 145.2 | 0.55 | 0.012 | exosome complex exonuclease RRP41 | RRP41 | gi: 9506688 Hs.343589 |
| 8 | 145.2 | 0.46 | 0.021 | exosome complex exonuclease RRP41 | RRP41 | gi: 54085 17 Hs.343589 |
| 8 | 145.2 | 0.37 | 0.031 | GPAA1P anchor attachment protein 1 homolog (yeast) | GPAA1 | gi: 6031166 Hs.4742 |
| 8 | 145.2 | 0.51 | 0.009 | GPAA1P anchor attachment protein 1 homolog (yeast); GPAA1P anchor attachment protein 1 homolog (yeast) | GPAA1 | gi: 13623546 Hs.4742; Hs.4742 |
| 8 | 145.2 | 0.45 | 0.014 | GPAA1P anchor attachment protein 1 homolog (yeast) | GPAA1 | gi: 7018511 Hs.4742 |
| 8 | 145.2 | 0.43 | 0.021 | cytochrome c-1 | CYC1 | gi: 4503184 Hs.289271 |
| 8 | 145.2 | 0.39 | 0.03 | hypothetical protein DKFZp434N1923; hypothetical protein DKFZp434N1923 | DKFZP434N1923 | gi: 13569949 Hs.295866; Hs.295866 |

TABLE 5-continued

Markers of the invention which reside in MCRs of amplification and display increased expression.

| | | | | | | |
|---|---|---|---|---|---|---|
| 8 | 145.3 | 0.31 | 0.014 | brain protein 16 | LOC51236 | gi: 13124772 Hs.300224 |
| 8 | 145.5 | 0.33 | 0.048 | diacylglycerol O-acyltransferase homolog 1 (mouse) | DGAT1 | gi: 7382489 Hs.512810 |
| 8 | 145.5 | 0.67 | <.005 | putative G-protein coupled receptor GPCR41 | FLJ11856 | gi: 13375681 Hs.6459 |
| 8 | 145.6 | 0.43 | 0.039 | cleavage and polyadenylation specific factor 1, 160 kDa | CPSF1 | gi: 10037183 Hs.83727 |
| 8 | 145.6 | 0.51 | 0.01 | solute carrier family 39 (zinc transporter), member 4 | SLC39A4 | gi: 8923304 Hs.411274 |
| 8 | 145.6 | 0.43 | 0.031 | vacuolar protein sorting 28 (yeast) | VPS28 | gi: 7705884 Hs.418175 |
| 8 | 145.6 | 0.44 | 0.036 | Homo sapiens mRNA, chromosome 1 specific transcript KIAA0496. | | gi: 7150895 Hs.459379 |
| 9 | 21.9 | 0.02 | <.005 | methylthioadenosine phosphorylase | MTAP | gi: 6006025 Hs.446152 |
| 9 | 35.6 | 0.48 | <.005 | tropomyosin 2 (beta) | TPM2 | gi: 1219494 Hs.300772 |
| 9 | 35.7 | 0.52 | 0.013 | talin 1 | TLN1 | gi: 5454129 Hs.375001 |
| 9 | 35.7 | 0.89 | <.005 | cAMP responsive element binding protein 3 | CREB3 | gi: 2599559 Hs.287921 |
| 9 | 35.7 | 0.84 | <.005 | KIAA0258 | KIAA0258 | gi: 7662029 Hs.47313 |
| 9 | 35.7 | 0.11 | 0.032 | natriuretic peptide receptor B/guanylate cyclase B (atrionatriuretic peptide receptor B) | NPR2 | gi: 2337354 Hs.78518 |
| 9 | 35.8 | 0.67 | 0.006 | nasopharyngeal carcinoma related protein | NGX6 | gi: 7706546 Hs.440953 |
| 9 | 36.1 | 1.33 | <.005 | clathrin, light polypeptide (Lca) | CLTA | gi: 6005992 Hs.207052 |
| 9 | 36.2 | 0.20 | 0.005 | clathrin, light polypeptide (Lca) | CLTA | gi: 704460 Hs.207052 |
| 9 | 36.3 | 0.49 | 0.021 | ring finger protein 38 | RNF38 | gi: 12232470 Hs.333503 |
| 12 | 22.1 | 0.62 | 0.006 | cytidine monophosphate N-acetylneuraminic acid synthetase | CMAS | gi: 8923899 Hs.311346 |
| 12 | 50 | 0.00 | 0.005 | elastase 1, pancreatic | ELA1 | gi: 4503546 Hs.348395 |
| 12 | 54.8 | 0.77 | 0.033 | myosin, light polypeptide 6, alkali, smooth muscle and non-muscle | MYL6 | gi: 2078957 Hs. 77385 |
| 13 | 22.8 | 0.84 | 0.011 | ADP-ribosyltransferase (NAD+; poly (ADP-ribose) polymerase)-like 1 | ADPRTL1 | gi: 11496990 Hs. 437959 |
| 13 | 23.6 | 0.67 | 0.035 | myotubularin related protein 6 | MTMR6 | gi: 1669390 Hs. 79877 |
| 13 | 24.5 | 2.81 | 0.042 | ring finger protein (C3H2C3 type) 6 | RNF6 | gi: 12656362 Hs.136885 |
| 13 | 112.9 | 0.32 | 0.011 | UPF3 regulator of nonsense transcripts homolog A (yeast) | UPF3A | gi: 12620405 Hs.399740 |
| 14 | 29.1 | 0.62 | 0.006 | chromosome 14 open reading frame 163 | C14orf163 | gi: 4240322 Hs.27023 |
| 14 | 29.5 | 0.41 | 0.038 | adaptor-related protein complex 4, sigma 1 subunit | AP4S1 | gi: 12654832 Hs.496614 |
| 14 | 30.1 | 0.80 | <.005 | chromosome 14 open reading frame 127 | C14orf127 | gi: 13376746 Hs.288981 |
| 14 | 30.6 | 0.46 | 0.032 | Rho GTPase activating protein 5 | ARHGAP5 | gi: 5905160 Hs.409546 |
| 14 | 31.8 | 0.56 | 0.043 | neuronal PAS domain protein 3 | NPAS3 | gi: 11545846 Hs.243209 |
| 14 | 32.9 | 1.12 | 0.007 | chromosome 14 open reading frame 11 | C14orf1 | gi: 8922092 Hs.433269 |
| 14 | 33 | 0.98 | <.005 | sorting nexin 6 | SNX6 | gi: 13027619 Hs.283443 |
| 14 | 52.4 | 1.17 | 0.013 | bone morphogenetic protein 4; bone morphogenetic protein 4 | BMP4 | gi: 576934 Hs.68879; Hs.68879 |
| 14 | 53.2 | 0.58 | 0.021 | sterile alpha motif domain containing 4 | SAMD4 | gi: 5689442 Hs.98259 |
| 14 | 53.4 | 0.48 | 0.025 | WD repeat and HMG-box DNA binding protein 1 | WDHD1 | gi: 7704203 Hs.385998 |
| 14 | 53.5 | 1.36 | <.005 | chromosome 14 open reading frame 32 | C14orf32 | gi: 10438139 Hs.406401 |
| 14 | 53.6 | 0.51 | 0.013 | discs, large homolog 7 (Drosophila) | DLG7 | gi: 7661851 Hs.77695 |
| 14 | 53.8 | 0.42 | 0.03 | F-box only protein 34 | FBXO34 | gi: 8923650 Hs.15467 |
| 14 | 54 | 0.29 | 0.025 | kinectin 1 (kinesin receptor) | KTN1 | gi: 11681348 Hs. 368212 |
| 14 | 55.6 | 0.62 | 0.006 | SEC10-like 1 (S. cerevisiae) | SEC10L1 | gi: 5730036 Hs. 365863 |
| 14 | 55.7 | 0.68 | <.005 | chromosome 14 open reading frame 108 | C14orf108 | gi: 8922687 Hs.106210 |
| 14 | 56.6 | 0.65 | 0.008 | actin-related protein 10 homolog (S. cerevisiae) | ACTR10 | gi: 10433604 Hs.248569 |
| 14 | 58.5 | 0.65 | 0.035 | chromosome 14 open reading frame 135 | C14orf135 | gi: 11968054 Hs.413671 |
| 14 | 59.8 | 0.62 | 0.041 | protein kinase C, eta | PRKCH | gi: 5453971 Hs.315366 |
| 14 | 60.1 | 0.76 | 0.006 | hypoxia-inducible factor 1, alpha subunit (basic helix-loop-helix transcription factor) | HIF1A | gi: 4504384 Hs.412416 |
| 14 | 60.2 | 0.43 | 0.03 | small nuclear RNA activating complex, polypeptide 1, 43 kDa | SNAPC1 | gi: 4507100 Hs. 179312 |
| 14 | 62.9 | 0.49 | 0.021 | zinc finger and BTB domain containing 1 | ZBTB1 | gi: 7662437 Hs. 511938 |
| 14 | 63.2 | 0.03 | 0.011 | KIAA0599 | KIAA0599 | gi: 13279160 Hs. 198037 |
| 14 | 39.1 | 0.66 | <.005 | SWI/SNF related, matrix associated, actin dependent regulator of chromatin, subfamily e, member 1 | SMARCE1 | gi: 13045953 Hs.437546 |
| 17 | 39.3 | 1.06 | <.005 | keratin 10 (epidermolytic hyperkeratosis; keratosis palmaris et plantaris) | KRT10 | gi: 4557696 Hs.99936 |
| 17 | 40.4 | 1.74 | <.005 | ATP citrate lyase | ACLY | gi: 5768107 Hs.387567 |
| 17 | 40.5 | 0.97 | 0.007 | I-kappa-B-interacting Ras-like protein 2 | KBRAS2 | gi: 8922150 Hs.502910 |
| 17 | 40.6 | 1.17 | 0.011 | RAB5C, member RAS occogene family | RAB5C | gi: 7672664 Hs.479 |
| 17 | 40.7 | 0.83 | 0.033 | signal transducer and activator of transcription 5B | STAT5B | gi: 9970172 Hs.434992 |
| 17 | 41 | 1.01 | <.005 | ATPase, H+ transporting, lysosomal V0 subunit a isoform 1 | ATP6V0A1 | gi: 4885084 Hs.267871 |
| 17 | 41 | 0.69 | 0.007 | transcription factor-like 4 | TCFL4 | gi: 11761691 Hs.383019 |
| 17 | 41.1 | 0.89 | 0.009 | GT198, complete ORF | HUMGT198A | gi: 1164152 Hs.279032 |
| 17 | 41.1 | 1.06 | 0.009 | hypothetical protein LOC162427 | LOC162427 | gi: 12779367 Hs.432850 |
| 17 | 41.2 | 1.30 | 0.005 | enhancer of zeste homolog 1 (Drosophila) | EZH1 | gi: 2224716 Hs.194669 |

TABLE 5-continued

Markers of the invention which reside in MCRs of amplification and display increased expression.

| | | | | | | | |
|---|---|---|---|---|---|---|---|
| 17 | 41.2 | 1.08 | <.005 | enhancer of zeste homolog 1 (*Drosophila*) | EZH1 | gi: 2224716 | Hs.194669 |
| 17 | 41.3 | 1.62 | <.005 | HSPC009 protein | HSPC009 | gi: 7661731 | Hs.16059 |
| 17 | 41.3 | 1.15 | <.005 | beclin 1 (coiled-coil, myosin-like BCL2 interacting protein) | BECN1 | gi: 4502394 | Hs.12272 |
| 17 | 41.3 | 1.56 | <.005 | proteasome (prosome, macropain) activator subunit 3 (PA28 gamma; Ki) | PSME3 | gi: 5031996 | Hs.152978 |
| 17 | 41.3 | 1.09 | <.005 | amine oxidase, copper containing 2 (retina-specific) | AOC2 | gi: 6806881 | Hs.143102 |
| 17 | 41.4 | 1.74 | <.005 | hypothetical protein MGC2744 | MFC2744 | gi: 3432163 | Hs.317403 |
| 17 | 41.5 | 1.86 | <.005 | ribosomal protein L27 | RPL27 | gi: 4506622 | Hs.405528 |
| 17 | 41.8 | 0.44 | 0.05 | *Homo sapiens* cDNA FLJ35853 fis, clone TESTI2007078, highly similar to MEMBRANE COMPONENT, CHROMOSOME 17, SURFACE MARKER 2. | | gi: 5935951 | Hs.277721 |
| 17 | 42.3 | 0.45 | <.005 | dual specificity phosphatase 3 (vaccinia virus phosphatase VH1-related) | DUSP3 | gi: 12803692 | Hs.181046 |
| 17 | 42.3 | 1.16 | <.005 | membrane protein, palmitoylated 3 (MAGUK p55 subfamily member 3) | MPP3 | gi: 4505238 | Hs.396566 |
| 17 | 42.4 | 0.63 | <.005 | membrane protein, palmitoylated 2 (MAGUK p55 subfamily member 2) | MPP2 | gi: 6991687 | Hs.436326 |
| 17 | 42.6 | 1.57 | <.005 | glucose-6-phosphatase catalytic subunit 3 | G6PC3 | gi: 12951784 | Hs.294005 |
| 17 | 42.6 | 1.39 | <.005 | glucose-6-phosphatase catalytic subunit 3 | G6PC3 | gi: 4834429 | Hs.294005 |
| 17 | 42.7 | 1.55 | <.005 | hypothetical protein MGC3123 | MGC3123 | gi: 13129117 | Hs.181391 |
| 17 | 42.9 | 0.92 | <.005 | granulin | GRN | gi: 4504150 | Hs.180577 |
| 17 | 42.9 | 0.45 | 0.006 | KIAA0553 protein | KIAA0553 | gi: 11008117 | Hs.396047 |
| 17 | 43.6 | 0.55 | 0.018 | N-myristoyltransferase 1 | NMT1 | gi: 2760893 | Hs.346743 |
| 17 | 43.7 | 0.34 | 0.031 | HMBA-inducible | HIS1 | gi: 7457641 | Hs.15299 |
| 17 | 44 | 1.09 | <.005 | hypothetical protein FLJ10120 | FLJ10120 | gi: 8922238 | Hs.378860 |
| 17 | 44.8 | 0.51 | 0.012 | ARF protein | LOC51326 | gi: 7770214 | Hs.500496 |
| 17 | 44.8 | 1.09 | <.005 | KIAA0563 gene product | KIAA0563 | gi: 3647821 | Hs.38861 |
| 17 | 45.2 | 0.92 | <.005 | N-ethylmaleimide-sensitive factor | NSF | gi: 11079227 | Hs.431279 |
| 17 | 45.3 | 0.42 | 0.041 | wingless-type MMTV integration site family, member 3; wingless-type MMTV integration site family, member 3 | WNT3 | gi: 13540476 | Hs.224667; Hs.224667 |
| 17 | 45.7 | 1.06 | <.005 | *Homo sapiens* transcribed sequence with weak similarity to protein sp: P30260 (*H. sapiens*) CC27_HUMAN Protein CD27Hs (Cell division cycle protein 27 homolog) (H-NUC) | | gi: 1126567 | Hs.514263 |
| 17 | 46.1 | 0.55 | 0.01 | aminopeptidase poromycin sensitive | NPEPPS | gi: 4210725 | Hs.293007 |
| 17 | 46.2 | 0.31 | <.005 | karyopherin (importin) beta 1 | KPNB2 | gi: 13097743 | Hs.439683 |
| 17 | 46.4 | 0.87 | 0.01 | pyridoxine-5'-phosphate oxidase | PNPO | gi: 8922497 | Hs.327335 |
| 17 | 46.6 | 1.27 | <.005 | chromobox homolog 1 (HP1 beta homolog *Drosophila*) | CBX1 | gi: 5803075 | Hs.77254 |
| 17 | 46.6 | 0.81 | 0.008 | sorting nexin 11 | SNX11 | gi: 7019538 | Hs.15827 |
| 17 | 46.6 | 0.78 | 0.01 | sorting nexin 11 | SNX11 | gi: 4827951 | Hs.15827 |
| 17 | 47.4 | 0.86 | <.005 | ATP synthase, H+ transporting, mitochondrial F0 complex, subunit c (subunit 9), isoform 1 | ATP5G1 | gi: 5262506 | Hs.80986 |
| 17 | 47.4 | 0.60 | 0.017 | hypothetical protein FLJ13855 | FLJ13855 | gi: 12751494 | Hs.369120 |
| 17 | 47.4 | 1.17 | <.005 | EAP30 subunit of ELL complex | EAP30 | gi: 6005754 | Hs.127249 |
| 17 | 47.8 | 0.49 | 0.021 | KIAA0924 protein | KIAA0924 | gi: 7662383 | Hs.190386 |
| 17 | 47.9 | 1.15 | <.005 | prohibitin | PHB | gi: 6031190 | Hs.75323 |
| 17 | 48.1 | 1.06 | <.005 | specide-type POZ protein | SPOP | gi: 4507182 | Hs.129951 |
| 17 | 48.2 | 1.61 | <.005 | solute carrier family 35, member B1 | SLC35B1 | gi: 5032212 | Hs: 154073 |
| 17 | 48.2 | 0.82 | <.005 | C/EBP-induced protein; C/EBP-induced protein | LOC81558 | gi: 13540589 | Hs.9851; Hs.9851 |
| 17 | 48.3 | 1.18 | <.005 | MYST histone acetyltransferase 2 | MYST2 | gi: 5901961 | Hs.21907 |
| 17 | 48.6 | 0.45 | 0.026 | integrin, alpha 3 (antigen CD49C, alpha 3 subunit of VLA-3 receptor) | ITGA3 | gi: 4504746 | Hs.265829 |
| 17 | 48.6 | 0.37 | 0.047 | pyruvate dehydrogenase kinase, isoenzyme 2 | PDK2 | gi: 5544583 | Hs.92261 |
| 17 | 48.9 | 0.45 | 0.03 | xylosyltransferase II | XYLT2 | gi: 11545913 | Hs.32117 |
| 17 | 48.9 | 0.91 | <.005 | hypothetical protein PRO1855 | PRO1855 | gi: 10437822 | Hs.370927 |
| 17 | 49 | 0.79 | <.005 | hypothetical protein FLJ20920 | FLJ20920 | gi: 13376740 | Hs.288959 |
| 17 | 49 | 0.57 | 0.017 | hypothetical protein FLJ11164 | FLJ11164 | gi: 8922910 | Hs.8033 |
| 17 | 49 | 0.60 | 0.016 | epsin 3 | EPN3 | gi: 8923677 | Hs.165904 |
| 17 | 49.1 | 0.57 | 0.018 | hypothetical protein FLJ21347 | FLJ21347 | gi: 12383067 | Hs.103147 |
| 17 | 49.2 | 0.93 | <.005 | hypothetical protein MGC15396; hypothetical protein MGC15396 | MGC15396 | gi: 13543385 | Hs.351247; Hs.351247 |
| 17 | 49.2 | 0.42 | 0.034 | cisplatin resistance-associated overexpressed protein | LUC7A | gi: 7706534 | Hs.130293 |
| 17 | 49.3 | 0.40 | 0.041 | cisplatin resistance-associated overexpressed protein | LUC7A | gi: 5174618 | Hs.130293 |
| 17 | 49.5 | 0.69 | 0.017 | sperm associated antigen 9 | SPAG9 | gi: 4504524 | Hs.500367 |
| 17 | 49.7 | 1.32 | <.005 | non_metastatic cells 1, protein (NM23A) expressed in | NME1 | gi: 4557796 | Hs.118638 |
| 17 | 49.7 | 1.75 | <.005 | non_metastatic cells 2, protein (NM23B) expressed in | NME2 | gi: 4505408 | Hs.433416 |

TABLE 5-continued

Markers of the invention which reside in MCRs of amplification and display increased expression.

| | | | | | | | |
|---|---|---|---|---|---|---|---|
| 17 | 49.8 | 1.01 | 0.005 | CGI-48 protein | CGI-48 | gi: 3179644 | Hs.441503 |
| 17 | 53.5 | 0.61 | 0.005 | COXII homolog, cytochrome c oxidase assembly protein (yeast) | COXII | gi: 4186577 | Hs.436988 |
| 17 | 53.8 | 0.23 | 0.01 | hepatic leukemia factor | HLF | gi: 184223 | Hs.250692 |
| 17 | 54.3 | 0.64 | 0.005 | phosphatidylcholine transfer protein | PCTP | gi: 10864026 | Hs.285218 |
| 17 | 74 | 0.63 | 0.028 | KIAA0195 gene product | KIAA0195 | gi: 7661985 | Hs.301132 |
| 17 | 74 | 1.07 | 0.009 | CASK interacting protein 2 | CASKIN2 | gi: 5766922 | Hs.274408 |
| 17 | 74 | 0.76 | 0.014 | CASK interacting protein 2 | CASKIN2 | gi: 5928096 | Hs.274408 |
| 18 | 19.3 | 0.56 | 0.022 | RIO kinase 3 (yeast) | RIOK3 | gi: 4507298 | Hs.209061 |
| 18 | 19.3 | 0.79 | 0.006 | RIO kinase 3 (yeast) | RIOK3 | gi: 5855068 | Hs.209061 |
| 18 | 19.3 | 1.02 | <.005 | colon cancer-associated protein Mic1 | MIC1 | gi: 7019454 | Hs.287633 |
| 18 | 19.3 | 0.95 | <.005 | Niemann-Pick disease, type C1 | NPC1 | gi: 4557802 | Hs.404930 |
| 18 | 19.9 | 0.48 | 0.024 | calcium-binding tyrosine-(Y)-phosphorylation regulated (fibroushealthin 2) | CABYR | gi: 6912377 | Hs.511983 |
| 18 | 20.1 | 0.48 | 0.022 | oxysterol binding protein-like 1A; oxysterol binding protein-like 1A; | OSBPL1A | gi: 13877169 | Hs.415753; Hs.415753 |
| 19 | 41.4 | 1.18 | <.005 | zinc finger protein 146 | ZNF146 | gi: 6005965 | Hs.301819 |
| 19 | 42.9 | 0.71 | 0.012 | hypothetical protein FLJ30921 | FLJ30921 | gi: 9722561 | Hs.290703 |
| 19 | 43.3 | 0.53 | 0.028 | D4, zinc and double PHD fingers family 1 | DPF1 | gi: 4758797 | Hs.389057 |
| 19 | 43.5 | 1.08 | <.005 | proteasome (prosome, macropain) 26S subunit, non-ATPase, 8 | PSMD8 | gi: 4506232 | Hs.78466 |
| 19 | 43.7 | 0.54 | 0.027 | mitogen-activated protein kinase kinase kinase kinase 1 | MAP4K1 | gi: 9970929 | Hs.95424 |
| 19 | 43.8 | 1.41 | <.005 | eukaryotic translation initiation factor 3 subunit k | eIF3k | gi: 5114050 | Hs.143773 |
| 19 | 43.8 | 1.43 | <.005 | eukaryotic translation initiation factor 3 subunit k | eIF3k | gi: 6038285 | Hs.143773 |
| 19 | 44 | 0.43 | 0.013 | heterogeneous nuclear ribonucleoprotein L | HNRPL | gi: 5935937 | Hs.446623 |
| 19 | 44 | 1.01 | <.005 | sirtutin (silent mating type information regulation 2 homolog) 2 (*S. cerevisiae*) | STRT2 | gi: 13775599 | Hs.375214 |
| 19 | 44 | 0.70 | <.005 | nuclear factor of kappa light polypeptide gene enhancer in B-cells inhibitor, beta | NFKBIB | gi: 4505384 | Hs.9731 |
| 19 | 44.1 | 0.86 | <.005 | seryl-tRNA synthetase 2 | SARS2 | gi: 8923420 | Hs.14220 |
| 19 | 44.1 | 0.12 | <.005 | mitochondrial ribosomal protein S12 | MRPS12 | gi: 2252149 | Hs.411125 |
| 19 | 44.1 | 0.56 | 0.019 | F-box only protein 26 | FBXO26 | gi: 13376364 | Hs.425352 |
| 19 | 44.3 | 0.40 | <.005 | p21(CDKNIA)-activated kinase 4 | PAK4 | gi: 7382497 | Hs.20447 |
| 19 | 44.3 | 0.83 | <.005 | p21(CDKNIA)-activated kinase 4 | PAK4 | gi: 4101586 | Hs.20447 |
| 19 | 44.5 | 1.16 | <.005 | hypothetical protein F23149_1 | PD2 | gi: 9506582 | Hs.152894 |
| 19 | 50.5 | 3.52 | 0.045 | RelA-associated inhibitor | RAI | gi: 5730000 | Hs.324051 |
| 19 | 50.6 | 1.27 | <.005 | CD3-epsilon-associated protein; antisense to ERCC-1 | ASE-1 | gi: 6912245 | Hs.446684 |
| 19 | 50.7 | 3.60 | 0.045 | optic atrophy 3 (autosomal recessive, with chorea and spastic parsplegia) | OPA3 | gi: 13376716 | Hs.123473 |
| 19 | 50.8 | 3.04 | 0.045 | echinoderm microtubule associated protein like 2 | EML2 | gi: 4568182 | Hs.24178 |
| 19 | 50.8 | 0.98 | 0.018 | gastric inhibitory polypeptide receptor | GIPR | gi: 4503998 | Hs.251412 |
| 19 | 50.8 | 1.00 | 0.044 | small nuclear ribonucleoprotein D2 polypeptide 16.5 kDa | SNRPD2 | gi: 7242206 | Hs.424327 |
| 19 | 50.9 | 0.65 | 0.012 | *Homo sapiens* cDNA FLJ90345 fis, clone NT2RP2002974, highly similar to HOMEOBOX PROTEIN SIX5. | | gi: 7151592 | Hs.43314 |
| 19 | 50.9 | 0.49 | <.005 | dystrophis myotonica-protein kinase | DMPK | gi: 189038 | Hs.898 |
| 19 | 51.8 | 0.71 | 0.005 | protein kinase D2 | PRKD2 | gi: 12659006 | Hs.205431 |
| 19 | 51.8 | 0.65 | 0.009 | protein kinase D2 | PRKD2 | gi: 4884153 | Hs.205431 |
| 19 | 51.9 | 1.42 | 0.008 | striatin, calmodulin binding protein 4 | STRN4 | gi: 7019572 | Hs.406918 |
| 19 | 51.9 | 0.90 | 0.009 | solute carrier family 1 (neutral amino acid transporter), member 5 | SLC1A5 | gi: 4191561 | Hs.183556 |
| 19 | 52 | 1.66 | <.005 | adaptor-related protein complex 2, sigma 1 subunit | AP2S1 | gi: 11038644 | Hs.119591 |
| 19 | 52 | 1.35 | <.005 | adaptor-related protein complex 2, sigma 1 subunit; adaptor-related protein complex 2, sigma 1 subunit | AP2S1 | gi: 13623468 | Hs.119591; Hs.119591 |
| 19 | 52.1 | 1.87 | 0.014 | glucocorticoid receptor DNA binding factor 1 | GRLF1 | gi: 4758481 | Hs.102548 |
| 19 | 52.5 | 1.05 | 0.036 | complement component 5 receptor 1 (C5a ligand) | C5R1 | gi: 4502508 | Hs.2161 |
| 19 | 52.6 | 2.86 | <.005 | N-ethylmaleimide-sensitive factor attachment protein, alpha | NAPA | gi: 4505328 | Hs.75932 |
| 19 | 52.9 | 3.79 | 0.045 | EH-domain containing 2 | EHD2 | gi: 7657053 | Hs.325650 |
| 19 | 52.9 | 5.29 | 0.045 | EH-domain containing 2 | EHD2 | gi: 4261421 | Hs.325650 |
| 19 | 52.9 | 4.35 | 0.045 | EH-domain containing 2 | EHD2 | gi: 4261421 | Hs.325650 |
| 19 | 53.3 | 2.23 | 0.045 | liase 1, DNA, ATP-dependent | LIG1 | gi: 4557718 | Hs.1770 |
| 19 | 53.5 | 1.97 | 0.045 | KDEL (Lys-Asp-Glu-Leu) endoplasmic reticulum protein retention receptor 1 | KDELR1 | gi: 5803047 | Hs.78040 |
| 19 | 53.6 | 3.06 | 0.045 | glutamate-rich WD repeat containing 1 | GRWD1 | gi: 13274610 | Hs.400625 |
| 19 | 53.8 | 1.25 | 0.041 | ribosomal protein L18 | RPL18 | gi: 4834123 | Hs.409634 |
| 19 | 53.8 | 1.82 | 0.013 | D site of albumin promoter (albumin D-box) binding protein | DBP | gi: 460704 | Hs.414480 |

TABLE 5-continued

Markers of the invention which reside in MCRs of amplification and display increased expression.

| | | | | | | | |
|---|---|---|---|---|---|---|---|
| 19 | 53.9 | 0.88 | 0.033 | fucosyltransferase 1 (galactoside 2-alpha-L-fucosyltransferase) | FUT1 | gi: 4503804 | Hs.69747 |
| 19 | 53.9 | 0.93 | 0.013 | fucosyltransferase 1 (galactoside 2-alpha-L-fucosyltransferase) | FUT1 | gi: 6739499 | Hs.69747 |
| 19 | 54 | 0.58 | 0.036 | pleckstrin homology domain containing, family A (phosphoinositide binding specific) member 4 | PLEKHA4 | gi: 10190743 | Hs.9469 |
| 19 | 54.1 | 0.43 | 0.044 | nucleobindin 1 | NUCB1 | gi: 5453817 | Hs.172609 |
| 19 | 54.1 | 0.63 | 0.032 | BCL2-associated X protein | BAX | gi: 4751837 | Hs.159428 |
| 19 | 54.1 | 1.36 | <.005 | glycogen synthase 1 (muscle) | GYS1 | gi: 4504232 | Hs.386225 |
| 19 | 54.1 | 1.13 | <.005 | RuvB-like 2 (E. coli) | RUVBL2 | gi: 5730022 | Hs.6455 |
| 19 | 54.2 | 0.94 | 0.011 | luteinizing hormone beta polypeptide | LHB | gi: 4504988 | Hs.154704 |
| 19 | 54.2 | 2.38 | <.005 | small nuclear ribonucleoprotein 70 kDa polypeptide (RNP antigen) | SNRP70 | gi: 4507118 | Hs.174051 |
| 19 | 54.5 | 0.95 | 0.011 | soggy-1 gene | DKKL1-pending | gi: 7657553 | Hs.124021 |
| 19 | 54.6 | 0.51 | 0.034 | ribosomal protein L13a | RPL13A | gi: 12653484 | Hs.449070 |
| 19 | 54.7 | 0.92 | 0.029 | reticulocalbin 3, EF-hand calcium binding domain | RCN3 | gi: 10257434 | Hs.439184 |
| 19 | 54.7 | 0.99 | 0.012 | nitric oxide synthase interacting protein | NOSIP | gi: 7705715 | Hs.7236 |
| 19 | 54.8 | 0.65 | 0.017 | interferon regulatory factor 3 | IRF3 | gi: 4504724 | Hs.75254 |
| 19 | 54.8 | 2.10 | 0.045 | HMT1 hnRNP methyltransferase-like 2 (S. cerevisiae) | HRMT1L2 | gi: 4504496 | Hs.20521 |
| 19 | 55 | 1.21 | 0.014 | prostate tumor overexpressed gene 1 | PTOV1 | gi: 4884338 | Hs.227429 |
| 19 | 55.1 | 2.89 | 0.045 | nucleoporin 62 kDa | NUP62 | gi: 7705354 | Hs.437023 |
| 19 | 55.5 | 0.48 | 0.024 | nuclear receptor subfamily 1, group H, member 2 | NR1H2 | gi: 11321629 | Hs.432976 |
| 19 | 56.2 | 0.11 | 0.007 | kallikrein 13 | KLK13 | gi: 4884461 | Hs.165296 |
| 19 | 58.7 | 1.51 | <.005 | zinc finger protein 331 | ZNF331 | gi: 10092612 | Hs.147644 |
| 19 | 59.3 | 1.45 | <.005 | CCR4-NOT transcription complex, subunit 3 | CNOT3 | gi: 7657386 | Hs.343571 |
| 19 | 59.3 | 0.87 | 0.013 | leukocyte receptor cluster (LRC) member 4 | LENG4 | gi: 13236521 | Hs.78768 |
| 16 | 59.3 | 0.65 | 0.013 | leukocyte receptor cluster (LRC) member 5 | LENG5 | gi: 13129061 | Hs.15580 |
| 19 | 59.4 | 0.73 | 0.019 | ribosomal protein S9 | RPS9 | gi: 4506744 | Hs.139876 |
| 19 | 60.3 | 0.50 | 0.018 | synaptotagmin V | SVT5 | gi: 4763527 | Hs.23179 |
| 19 | 60.8 | 1.68 | 0.01 | LDL induced EC protein | LOC51157 | gi: 7705880 | Hs.94392 |
| 19 | 60.8 | 0.88 | 0.019 | U2 (RNU2) small nuclear RNA auxiliary factor 2 | U2AF2 | gi: 5396722 | Hs.297629 |
| 19 | 60.8 | 1.08 | 0.027 | epsin 1 | EPN1 | gi: 7019368 | Hs.279953 |
| 19 | 61.2 | 1.42 | <.005 | hypothetical protein LOC126208 | LOC126108 | gi: 1496048 | Hs.397153 |
| 19 | 61.3 | 0.55 | 0.039 | zinc finger protein 444 | ZNF444 | gi: 8922893 | Hs.24545 |
| 19 | 61.3 | 0.62 | 0.027 | zinc finger protein 444 | ZNF444 | gi: 3916863 | Hs.24545 |
| 19 | 62.4 | 0.69 | 0.022 | zinc finger protein 264 | ZNF264 | gi: 4585642 | Hs.426358 |
| 19 | 62.4 | 0.79 | <.005 | zinc finger protein 272 | ZNF272 | gi: 498733 | Hs.99971 |
| 19 | 62.5 | 0.44 | 0.043 | zinc finger protein 304 | ZNF304 | gi: 10190695 | Hs.287374 |
| 19 | 62.6 | 0.66 | 0.008 | hypothetical protein FLJ23233 | FLJ23233 | gi: 13375967 | Hs.98593 |
| 19 | 62.6 | 0.60 | 0.023 | hypothetical protein FLJ23233 | FLJ23233 | gi: 2112716 | Hs.98593 |
| 19 | 62.8 | 0.60 | 0.022 | zinc finger protein 134 (clone pHZ-15) | ZNF134 | gi: 4507982 | Hs.449971 |
| 19 | 62.8 | 1.08 | <.005 | zinc finger protein 211 | ZNF211 | gi: 5454175 | Hs.449970 |
| 20 | 30.9 | 0.62 | 0.008 | inhibitor of DNA binding 1, dominant negative helix-loop-helix protein | ID1 | gi: 464181 | Hs.410900 |
| 20 | 58.2 | 0.70 | <.005 | ATP synthase, H+ transporting, mitochondrial F1 complex, epsilon subunit | ATP5E | gi: 5901895 | Hs.177530 |
| 20 | 58.2 | 0.65 | <.005 | chromosome 20 open reading frame 45 | C20orf45 | gi: 7705609 | Hs.3945 |
| 20 | 59.2 | 0.68 | <.005 | protein phosphatase 1, regulatory subunit 3D | PPP1R3D | gi: 6806895 | Hs.504920 |
| 20 | 61.2 | 0.00 | 0.025 | TAF4 RNA polymerase II, TATA box binding protein (TBP)-associated factor, 135 kDa | TAF4 | gi: 5112317 | Hs.24644 |
| 20 | 61.4 | 0.45 | 0.015 | synovial sarcoma translocation gene on chromosome 18-like 1 | SS18L1 | gi: 3327199 | Hs.154429 |
| 20 | 61.4 | 0.38 | 0.048 | proteasome (prosome, macropain) subunit, alpha type, 7 | PSMA7 | gi: 9408092 | Hs.233952 |
| 20 | 61.5 | 0.59 | <.005 | oxysterol binding protein-like 2 | OSBPL2 | gi: 12653062 | Hs.15519 |
| 20 | 61.5 | 0.37 | 0.049 | laminin, alpha 5 | LAMA5 | gi: 13097167 | Hs.11669 |
| 20 | 61.6 | 0.06 | <.005 | ribosomal protein S21 | RPS21 | gi: 4506698 | Hs.372960 |
| 20 | 62.2 | 0.49 | 0.018 | transcription factor-llke 5 (basic helix-loop-helix) | TCFL5 | gi: 5730082 | Hs.30696 |
| 20 | 62.2 | 0.39 | 0.03 | chromosome 20 open reading frame 11 | C20orf11 | gi: 8923556 | Hs.103808 |
| 20 | 62.5 | 0.82 | <.005 | chromosome 20 open reading frame 21 | C20orf21 | gi: 9663381 | Hs.11747 |
| 20 | 63 | 0.46 | 0.018 | ADP-ribosylation factor related protein 1 | ARFRP1 | gi: 8246778 | Hs.389277 |
| 20 | 63 | 0.41 | 0.032 | KIAA1847 | KIAA1847 | gi: 8246778 | Hs.11900 |
| 20 | 63 | 0.37 | 0.03 | ADP-ribosylation factor related protein 1 | ARFRP1 | gi: 4507448 | Hs.389277 |
| 20 | 63 | 0.48 | 0.016 | KIAA1847 | KIAA1847 | gi: 2279318 | Hs.11900 |
| 20 | 63.2 | 0.77 | <.005 | tumor protein D52-like 2 | TPD52L2 | gi: 4507642 | Hs.154718 |
| 20 | 63.3 | 0.73 | <.005 | uridine kinase-like 1 | URKL1 | gi: 8923486 | Hs.504998 |
| 20 | 63.3 | 0.75 | <.005 | chromosome 20 open reading frame 14 | C20orf14 | gi: 13401215 | Hs.31334 |
| 22 | 22.6 | 0.59 | 0.031 | D-dopachrome tautomerase | DDT | gi: 5453630 | Hs.433902 |
| 22 | 22.7 | 0.42 | 0.018 | glutathione S-transferase theta 1 | GSTT1 | gi: 4504184 | Hs.268573 |
| 22 | 29.6 | 0.46 | 0.015 | hypothetical protein FLJ20618 | FLJ20618 | gi: 7021031 | Hs.52184 |
| 22 | 29.6 | 0.65 | <.005 | hypothetical protein FLJ20618 | FLJ20618 | gi: 4899032 | Hs.52184 |

TABLE 5-continued

Markers of the invention which reside in MCRs of amplification and display increased expression.

| Chromosome | Locus Link | Regulation | Probes | Ref Seq mRna ID | SEQ ID NO.: Nuc. | Ref Seq Prot ID | SEQ ID NO.: A.A. |
|---|---|---|---|---|---|---|---|
| 1 | 10726 | UP | 201173_x_at | NM_006600 | 445 | NP_006591 | 1196 |
| 1 | 8458 | UP | 204407_at | NM_003594 | 1 | NP_003585 | 756 |
| 1 | 10885 | UP | 218882_s_at | NM_006784 | 2 | NP_006775 | 757 |
| 2 | 130814 | UP | 216458_at | NM_152391 | 458 | NP_689604 | 1209 |
| 5 | 6389 | UP | 201093_x_at | NM_004168 | 3 | NP_004159 | 758 |
| 5 | 10016 | UP | 203415_at | NM_013232 | 4 | NP_037364 | 759 |
| 5 | 11336 | UP | 212630_at | NM_007277 | 5 | NP_009208 | 760 |
| 5 | 55722 | UP | 219531_at | NM_018140 | 6 | NP_060610 | 761 |
| 5 | 65980 | UP | 220155_s_at | NM_023924 | 7 | NP_076413 | 762 |
| 5 | 79888 | UP | 201818_at | NM_024830 | 8 | NP_079106 | 763 |
| 5 | 4726 | UP | 203606_at | NM_004553 | 9 | NP_004544 | 764 |
| 5 | 23379 | UP | 209654_at | XM_029101 | 10 | XP_029101 | 765 |
| 6 | 7148 | UP | 213451_x_at | NM_019105; NM_032470 | 11; 12 | NP_061978; NP_115859 | 766; 767 |
| 6 | 10695 | UP | 217931_at | NM_006586; NM_183010 | 13; 14 | NP_006577; NP_898828 | 768; 769 |
| 6 | 5528 | UP | 202513_s_at | NM_006245; NM_180976; NM_180977 | 15; 16; 17 | NP_006236; NP_851307; NP_851308 | 770; 771; 772 |
| 7 | 2852 | UP | 211829_s_at | NM_001505 | 18 | NP_001496 | 773 |
| 7 | 2852 | UP | 210640_s_at | NM_001505 | 19 | NP_001496 | 774 |
| 7 | 26173 | UP | 212212_s_at | XM_291222 | 20 | XP_291222 | 775 |
| 7 | 79778 | UP | 219332_at | NM_024723; NM_182924 | 21; 22 | NP_078999; NP_891554 | 776; 777 |
| 7 | 7975 | UP | 206750_at | NM_002360 | 23 | NP_002351 | 778 |
| 7 | 8379 | UP | 204857_at | NM_003550 | 24 | NP_003541 | 779 |
| 7 | 2617 | UP | 208693_s_at | NM_002047 | 25 | NP_002038 | 780 |
| 7 | 435 | UP | 204608_at | NM_000048 | 26 | NP_000039 | 781 |
| 7 | 27297 | UP | 203899_s_at | NM_014478 | 27 | NP_055293 | 782 |
| 7 | 154881 | UP | 213474_at | NM_153033 | 28 | NP_694578 | 783 |
| 7 | 27342 | UP | 218310_at | NM_014504 | 29 | NP_055319 | 784 |
| 7 | 55069 | UP | 218008_at | NM_017994 | 30 | NP_060464 | 785 |
| 7 | 10282 | UP | 202710_at | NM_005868 | 31 | NP_005859 | 786 |
| 7 | 64921 | UP | 219342_at | NM_022900 | 32 | NP_075051 | 787 |
| 7 | 5446 | UP | 213695_at | NM_000940 | 33 | NP_000931 | 788 |
| 7 | 5445 | UP | 210830_s_at | NM_000305 | 34 | NP_000296 | 789 |
| 7 | 5166 | UP | 205960_at | NM_002612 | 35 | NP_002603 | 790 |
| 7 | 10165 | UP | 203775_at | NM_014251 | 36 | NP_055066 | 791 |
| 7 | 7979 | UP | 202276_at | NM_006304 | 37 | NP_006295 | 792 |
| 7 | 57001 | UP | 218981_at | NM_020186 | 38 | NP_064571 | 793 |
| 7 | 440 | UP | 205047_s_at | NM_001673; NM_133436; NM_183356 | 39; 40; 41 | NP_001664; NP_597680; NP_899199 | 794; 795; 796 |
| 7 | | UP | 217499_x_at | | 1516 | | |
| 7 | 22853 | UP | 206223_at | NM_014916 | 42 | NP_055731 | 797 |
| 7 | 8295 | UP | 20642_s_at | NM_003496 | 43 | NP_003487 | 798 |
| 7 | 57154 | UP | 212668_at | NM_020429; NM_181349 | 44; 45 | NP_065162; NP_851994 | 799; 800 |
| 7 | 8295 | UP | 214908_a_at | NM_003496 | 46 | NP_003487 | 801 |
| 7 | 57154 | UP | 215458_s_at | NM_020429; NM_181349 | 47; 48 | NP_065162; NP_851994 | 802; 803 |
| 7 | | UP | 215589_at | | 1517 | | — |
| 7 | | UP | 215457_at | | 1518 | | — |
| 7 | 10552 | UP | 200950_at | NM_006409 | 49 | NP_006400 | 804 |
| 7 | 10095 | UP | 201954_at | NM_005720 | 50 | NP_005711 | 805 |
| 7 | 23600 | UP | 203731_s_at | NM_014569; NM_145102 | 51; 52 | NP_055384; NP_659570 | 806; 807 |
| 7 | 1577 | UP | 214234_s_at | NM_000777 | 53 | NP_000768 | 808 |
| 7 | 1577 | UP | 205765_at | NM_000777 | 54 | NP_000768 | 809 |
| 7 | 9179 | UP | 209837_at | NM_004722 | 55 | NP_004713 | 810 |
| 7 | 6878 | UP | 203572_s_at | NM_005641; NM_139122; NM_139123; NM_139315 | 56; 57; 58; 59 | NP_005632; NP_620834; NP_620835; NP_647476 | 811; 812; 813; 814 |
| 7 | 5384 | UP | 215667_x_at | | 1519 | | — |
| 7 | 2783 | UP | 200852_x_at | NM_005273 | 60 | NP_005264 | 815 |
| 7 | 56996 | UP | 220371_s_at | NM_020246 | 61 | NP_064631 | 816 |
| 7 | 8985 | UP | 202185_at | NM_001084 | 62 | NP_001075 | 817 |
| 7 | 10467 | UP | 201541_s_at | NM_006349 | 63 | NP_006340 | 818 |
| 7 | 51024 | UP | 218034_at | NM_016068 | 64 | NP_057152 | 819 |
| 7 | 93408 | UP | 221659_s_at | NM_138403 | 65 | NP_612412 | 820 |
| 7 | 80228 | UP | 218811_at | NM_032831 | 66 | NP_079432; NP_116220 | 821 |
| 7 | 29060 | UP | 220692_at | NM_014147 | 67 | NP_054866 | 822 |
| 7 | 5439 | UP | 212707_s_at | NM_006234 | 68 | NP_006225 | 823 |

TABLE 5-continued

Markers of the invention which reside in MCRs of amplification and display increased expression.

| | | | | | | | |
|---|---|---|---|---|---|---|---|
| 7 | 246721 | UP | 214740_at | NM_032958; NM_032959; NM_145325 | 69; 70; 71 | NP_116580; NP_116581; NP_663165 | 824; 825; 826 |
| 7 | 246721 | UP | 208534_s_at | NM_032958; NM_032959; NM_145325 | 72; 73; 74 | NP_116580; NP_116581; NP_663165 | 827; 828; 829 |
| 7 | 222255 | UP | 214342_at | NM_152749 | 75 | NP_689962 | 830 |
| 7 | 6856 | UP | 201259_s_at | NM_006754; NM_182715 | 76; 77 | NP_006745; NP_874384 | 831; 832 |
| 7 | 5172 | UP | 206529_x_at | NM_000441 | 78 | NP_000432 | 833 |
| 7 | 79872 | UP | 220018_at | NM_024814 | 79 | NP_079090 | 834 |
| 7 | 1738 | UP | 209095_at | NM_000108 | 80 | NP_000099 | 835 |
| 7 | 9732 | UP | 205003_at | NM_014705 | 81 | NP_055520 | 836 |
| 8 | 25960 | UP | 221814_at | NM_032777 | 82 | NP_116166 | 837 |
| 8 | 25960 | UP | 65718_at | NM_032777 | 83 | NP_116166 | 838 |
| 8 | 55290 | UP | 218954_s_at | NM_018310 | 84 | NP_060780 | 839 |
| 8 | 9070 | UP | 209517_s_at | NM_004674 | 85 | NP_004665 | 840 |
| 8 | 27257 | UP | 203534_at | NM_014462 | 86 | NP_055277 | 841 |
| 8 | 9530 | UP | 219624_at | NM_004874 | 87 | NP_004865 | 842 |
| 8 | 23259 | UP | 212690_at | NM_291291 | 88 | XP_291291 | 843 |
| 8 | 54904 | UP | 218173_s_at | NM_017778; NM_023034 | 89; 90 | NP_060248; NP_075447 | 844; 845 |
| 8 | 6873 | UP | 209523_at | NM_003184 | 91 | NP_003175 | 846 |
| 8 | 28998 | UP | 218049_s_at | NM_014078 | 92 | NP_054797 | 847 |
| 8 | 3037 | UP | 206432_at | NM_005328 | 93 | NP_005319 | 848 |
| 8 | 79139 | UP | 218172_s_at | NM_024295 | 94 | NP_061100; NP_077271 | 849 |
| 8 | 79139 | UP | 219402_s_at | NM_024295 | 95 | NP_061100; NP_077271 | 850 |
| 8 | 93594 | UP | 214061_at | NM_145647 | 96 | NP_663622 | 851 |
| 8 | 55093 | UP | 219060_at | NM_018024 | 97 | NP_060494 | 852 |
| 8 | 312 | UP | 208323_s_at | NM_004306 | 98 | NP_004297 | 853 |
| 8 | 11236 | UP | 209510_at | NM_007218 | 99 | NP_009149 | 854 |
| 8 | 9897 | UP | 201985_at | NM_014846 | 100 | NP_055661 | 855 |
| 8 | 4609 | UP | 202431_s_at | NM_002467 | 101 | NP_002458 | 856 |
| 8 | 375682 | UP | 216240_at | | 1520 | | — |
| 8 | 51571 | UP | 217916_s_at | NM_016623 | 102 | NP_057707 | 857 |
| 8 | 51105 | UP | 219606_at | NM_016018; NM_024878; NM_032205; NM_198513 | 103; 104; 105; 106 | NP_057102; NP_079154; NP_115581; NP_940915 | 858; 859; 860; 861 |
| 8 | 10397 | UP | 200632_s_at | NM_006096 | 107 | NP_006087 | 862 |
| 8 | 5747 | UP | 208820_at | NM_005607; NM_153831 | 108; 109 | NP_005598; NP_722560 | 863; 864 |
| 8 | 51337 | UP | 218500_at | NM_016647 | 110 | NP_057731 | 865 |
| 8 | 23144 | UP | 213445_at | NM_015117 | 111 | NP_055932 | 866 |
| 8 | 79792 | UP | 218154_at | NM_024736 | 112 | NP_079012 | 867 |
| 8 | 1936 | UP | 214394_x_at | NM_001960; NM_032378 | 113; 114 | NP_001951; NP_115754 | 868; 869 |
| 8 | 7264 | UP | 201644_at | NM_003313 | 115 | NP_003304 | 870 |
| 8 | 7264 | UP | 36936_at | NM_003313 | 116 | NP_003304 | 871 |
| 8 | 9831 | UP | 206188_at | | 1521 | | 1522 |
| 8 | 23513 | UP | 212556_at | NM_015356; NM_182706 | 117 | NP_056171; NP_874365 | 872; 873 |
| 8 | 26873 | UP | 222025_s_at | XM_291266 | 118 | XP_291266 | 874 |
| 8 | 54512 | UP | 91682_at | NM_019037 | 119 | NP_061910 | 875 |
| 8 | 54512 | UP | 218695_at | NM_019037 | 120 | NP_061910 | 876 |
| 8 | 54512 | UP | 58696_at | NM_019037 | 121 | NP_061910 | 877 |
| 8 | 8733 | UP | 201618_x_at | NM_003801 | 122 | NP_003792 | 878 |
| 8 | 8733; 8733 | UP | 211060_x_at | NM_003801 | 123 | NP_003792 | 879 |
| 8 | 8733 | UP | 215690_x_at | NM_003801 | 124 | NP_003792 | 880 |
| 8 | 1537 | UP | 201066_at | NM_001916 | 125 | NP_001907 | 881 |
| 8 | 81858; 81858 | UP | 220973_s_at | NM_030974 | 126 | NP_112236 | 882 |
| 8 | 51236 | UP | 219071_x_at | NM_016458 | 127 | NP_057542 | 883 |
| 8 | 8694 | UP | 203669_s_at | NM_012079 | 128 | NP_036211 | 884 |
| 8 | 79581 | UP | 218151_x_at | NM_024531 | 129 | NP_078807 | 885 |
| 8 | 29894 | UP | 201638_s_at | NM_013291 | 130 | NP_037423 | 886 |
| 8 | 55630 | UP | 219215_s_at | NM_017767; NM_130849 | 131; 132 | NP_060237; NP_570901 | 887; 878 |
| 8 | 51160 | UP | 218679_s_at | NM_016208; NM_183057 | 133; 134 | NP_057292; NP_898880 | 879; 880 |
| 8 | | UP | 213681_at | | 1523 | | — |
| 9 | 4507 | UP | 204956_at | NM_002451 | 555 | NP_002442 | 1303 |
| 9 | 7169 | UP | 212654_at | NM_003289 | 135 | NP_003280 | 891 |
| 9 | 7094 | UP | 203254_s_at | NM_006289 | 136 | NP_006280 | 892 |
| 9 | 10488 | UP | 209432_s_at | NM_006368 | 137 | NP_006359 | 893 |
| 9 | 9827 | UP | 203169_at | XM_376830 | 138 | XP_376830 | 894 |

TABLE 5-continued

Markers of the invention which reside in MCRs of amplification and display increased expression.

| | | | | | | |
|---|---|---|---|---|---|---|
| 9 | 4882 | UP | 214066_x_at | NM_000907; NM_003995 | 139; 140 | NP_000898; NP_003986 | 895 |
| 9 | 51754 | UP | 207839_s_at | NM_016446 | 141 | NP_057530 | 896 |
| 9 | 1211 | UP | 200960_x_at | NM_001833; NM_007096 | 142; 143 | NP_001824; NP_009027 | 897; 898 |
| 9 | 1211 | UP | 216293_at | NM_001833; NM_007096 | 144; 145 | NP_001824; NP_009027 | 899; 900 |
| 9 | 152006 | UP | 218528_s_at | NM_022781; NM_194328; NM_194329; NM_194330; NM_194331; NM_194332 | 146; 147; 148; 149; 150; 151 | NP_073618; NP_919309; NP_919310; NP_919311; NP_919312; NP_919313 | 901; 902; 903; 904; 905; 906 |
| 12 | 55907 | UP | 218111_s_at | NM_018686 | 152 | NP_061156 | 907 |
| 12 | 1990 | UP | 206446_s_at | NM_001971 | 586 | NP_001962 | 1331 |
| 12 | 4637 | UP | 214002_at | NM_021019; NM_079423; NM_079424; NM_079425 | 610; 611; 612; 613 | NP_066299; NP_524147; NP_524148; NP_524149 | 1355; 1356; 1357; 1358 |
| 13 | 143 | UP | 202239_at | NM_006437 | 153 | NP_006428 | 908 |
| 13 | 9107 | UP | 214429_at | NM_004685 | 154 | NP_004676 | 909 |
| 13 | 6049 | UP | 210931_at | NM_005977; NM_183043; NM_183044; NM_183045 | 155; 156; 157; 158 | NP_005968; NP_898864; NP_898865; NP_898866 | 910; 911; 912; 913 |
| 13 | 65110 | UP | 206958_s_at | NM_023011; NM_080687 | 159; 160 | NP_075387; NP_542418 | 914; 915 |
| 14 | 23256 | UP | 215548_s_at | NM_016106; NM_182835 | 161; 162 | NP_057190; NP_878255 | 916; 917 |
| 14 | 11154 | UP | 210952_at | NM_007077 | 163 | NP_009008 | 918 |
| 14 | 80224 | UP | 220176_at | NM_025152 | 164 | NP_079428 | 919 |
| 14 | 394 | UP | 217936_at | NM_001173 | 165 | NP_001164 | 920 |
| 14 | 64067 | UP | 220316_at | NM_022123; NM_173159 | 166; 167 | NP_071406; NP_775182 | 921; 922 |
| 14 | 55837 | UP | 202623_at | NM_018453 | 168 | NP_060923 | 923 |
| 14 | 58533 | UP | 217789_at | NM_021249; NM_152233 | 169; 170 | NP_067072; NP_689419 | 924; 925 |
| 14 | 652; 652 | UP | 211518_s_at | NM_001202; NM_130850; NM_130851; NM_001202; NM_130850; NM_130851 | 171; 172; 173; 174; 175; 176 | NP_001193; NP_570911; NP_570912 | 926; 927; 928 |
| 14 | 23034 | UP | 212845_at | NM_015589 | 177 | NP_056404 | 929 |
| 14 | 11169 | UP | 204727_at | NM_007086 | 178 | NP_009017 | 930 |
| 14 | 93487 | UP | 212499_s_at | NM_144578 | 179 | NP_653179 | 931 |
| 14 | 9787 | UP | 203764_at | NM_014750 | 180 | NP_055565 | 932 |
| 14 | 55030 | UP | 218539_at | NM_017943 | 181 | NP_060413 | 933 |
| 14 | 3895 | UP | 200914_x_at | NM_182926 | 182 | NP_891556 | 934 |
| 14 | 10640 | UP | 218748_s_at | NM_006544 | 183 | NP_006535 | 935 |
| 14 | 55745 | UP | 218139_s_at | NM_018229 | 184 | NP_060699 | 936 |
| 14 | 55860 | UP | 222230_s_at | NM_018477 | 185 | NP_060947 | 937 |
| 14 | 64430 | UP | 219972_s_at | NM_022495 | 186 | NP_071940 | 938 |
| 14 | 5583 | UP | 206099_at | NM_006255; | 187 | NP_006246; NP_076969 | 939 |
| 14 | 3091 | UP | 200989_at | NM_001530; NM_181054 | 188; 189 | NP_001521; NP_851397 | 940; 941 |
| 14 | 6617 | UP | 205443_at | NM_003082 | 190 | NP_003073 | 942 |
| 14 | 22890 | UP | 205092_x_at | XM_375086 | 191 | XP_375086 | 943 |
| 14 | 26030 | UP | 217044_s_at | | 1524 | | 1525 |
| 14 | 6605 | UP | 211988_at | NM_003079 | 192 | NP_003070 | 944 |
| 17 | 3858 | UP | 207023_x_at | NM_000421 | 193 | NP_000412 | 945 |
| 17 | 47 | UP | 201127_s_at | NM_001096; NM_198830 | 194; 195 | NP_001087; NP_942127 | 946 |
| 17 | 28511 | UP | 218240_at | NM_017595 | 196 | NP_060065 | 947 |
| 17 | 5878 | UP | 201156_s_at | NM_004583; NM_201434 | 197; 198 | NP_004574; NP_958842 | 948; 949 |
| 17 | 6777 | UP | 212549_at | NM_012448 | 199 | NP_036580 | 950 |
| 17 | 535 | UP | 205095_s_at | NM_005177 | 200 | NP_005168 | 951 |
| 17 | 6945 | UP | 210752_s_at | NM_170607; NM_198204; NM_198205 | 201; 202; 203 | NP_733752; NP_937847; NP_937848 | 952; 953; 954 |
| 17 | 29893 | UP | 213708_s_at | NM_013290; NM_016556 | 204; 205 | NP_037422; NP_057640 | 955; 956 |
| 17 | 162427 | UP | 212697_at | NM_178126 | 206 | NP_835227 | 957 |
| 17 | 2145 | UP | 203249_at | NM_001991 | 207 | NP_001982 | 958 |
| 17 | 2145 | UP | 32259_at | NM_001991 | 208 | NP_001982 | 959 |
| 17 | 28958 | UP | 218026_at | NM_014019 | 209 | NP_054738 | 960 |

TABLE 5-continued

Markers of the invention which reside in MCRs of amplification and display increased expression.

| | | | | | | | |
|---|---|---|---|---|---|---|---|
| 17 | 8678 | UP | 208945_s_at | NM_003766 | 210 | NP_003757 | 961 |
| 17 | 10197 | UP | 200988_s_at | NM_005789; NM_176863 | 211; 212 | NP_005780; NP_789839 | 962; 963 |
| 17 | 314 | UP | 207064_s_at | NM_001158; NM_009590 | 213; 214 | NP_001149; NP_0033720 | 964; 965 |
| 17 | 80755 | UP | 222064_s_at | NM_025267 | 215 | NP_079543 | 966 |
| 17 | 6155 | UP | 200025_at | NM_000988 | 216 | NP_000979 | 967 |
| 17 | | UP | 201383_s_at | | 1526 | | |
| 17 | 1845 | UP | 201537_s_at | NM_004090 | 217 | NP_004081 | 968 |
| 17 | 4356 | UP | 206186_at | NM_001932 | 218 | NP_001923 | 969 |
| 17 | 4355 | UP | 213270_at | NM_005374 | 219 | NP_005365 | 970 |
| 17 | 92579 | UP | 221759_at | NM_138387 | 220 | NP_612396 | 971 |
| 17 | 92579 | UP | 44654_at | NM_138387 | 221 | NP_612396 | 972 |
| 17 | 79089 | UP | 218419_s_at | NM_024107; NM_17741 | 222; 223 | NP_077012; NP_803190 | 973; 974 |
| 17 | 2896 | UP | 200678_x_at | NM_002087 | 224 | NP_002078 | 975 |
| 17 | 23131 | UP | 212485_at | XM_290758 | 225 | XP_290758 | 976 |
| 17 | 4836 | UP | 201157_s_at | NM_021079 | 226 | NP_066565 | 977 |
| 17 | 10614 | UP | 214188_at | NM_006460 | 227 | NP_006451 | 978 |
| 17 | 55073 | UP | 220219_s_at | NM_018001 | 228 | NP_060471 | 979 |
| 17 | 51326 | UP | 210718_s_at | NM_016632 | 229 | NP_057716 | 980 |
| 17 | 9884 | UP | 221740_x_at | NM_014834 | 230 | NP_055649 | 981 |
| 17 | 4905 | UP | 202395_at | NM_006178 | 231 | NP_006169 | 982 |
| 17 | 7473; 7473 | UP | 221455_s_at | NM_030753 | 232 | NP_110380 | 983 |
| 17 | | UP | 217880_at | | 1527 | | — |
| 17 | 9520 | UP | 201455_s_at | NM_006310 | 235 | NP_006301 | 986 |
| 17 | 3837 | UP | 208974_x_at | NM_002265 | 236 | NP_002256 | 987 |
| 17 | 55163 | UP | 218511_s_at | NM_018129 | 237 | NP_060599 | 988 |
| 17 | 10951 | UP | 201518_at | NM_006807 | 238 | NP_006798 | 989 |
| 17 | 29916 | UP | 220140_s_at | NM_013323; NM_152244 | 239; 240 | NP_037455; NP_689450 | 990; 991 |
| 17 | 29916 | UP | 53912_at | NM_013323; NM_152244 | 241; 242 | NP_689450 NP_689450 | 992; 993 |
| 17 | 516 | UP | 208972_s_at | NM_005175 | 243 | NP_005166 | 994 |
| 17 | 65264 | UP | 217750_s_at | NM_023079 | 244 | NP_075567 | 995 |
| 17 | 11267 | UP | 218391_at | NM_007241 | 245 | NP_009172 | 996 |
| 17 | 22834 | UP | 205594_at | XM_375471 | 246 | XP_375471 | 997 |
| 17 | 5245 | UP | 200659_s_at | NM_002634 | 247 | NP_002625 | 998 |
| 17 | 8405 | UP | 204640_s_at | NM_003563 | 248 | NP_003554 | 999 |
| 17 | 10237 | UP | 202433_at | NM_005827 | 249 | NP_005818 | 1000 |
| 17 | 81558; 81558 | UP | 221249_s_at | NM_030802 | 250 | NP_110429 | 1001 |
| 17 | 11143 | UP | 200049_at | NM_007067 | 251 | NP_008998 | 1002 |
| 17 | 3675 | UP | 201474_s_at | NM_002204; NM_005501 | 252; 253 | NP_002195; NP_005492 | 1003; 1004 |
| 17 | 5164 | UP | 213724_s_at | NM_002611 | 254 | NP_002602 | 1005 |
| 17 | 64132 | UP | 219401_at | NM_022167 | 255 | NP_071450 | 1006 |
| 17 | 55379 | UP | 222231_s_at | NM_018509 | 256 | NP_060979 | 1007 |
| 17 | 80221 | UP | 218844_at | NM_025149 | 257 | NP_079425 | 1008 |
| 17 | 55316 | UP | 218307_at | NM_018346 | 258 | NP_060816 | 1009 |
| 17 | 55040 | UP | 220318_at | NM_017957 | 259 | NP_060427 | 1010 |
| 17 | 64847 | UP | 218164_at | NM_022827 | 260 | NP_073738 | 1011 |
| 17 | 91369; 91369 | UP | 211717_at | NM_052855 | 261 | NP_443087 | 1012 |
| 17 | 51747 | UP | 220044_x_at | NM_016424 | 262 | NP_057508 | 1013 |
| 17 | 51747 | UP | 203804_s_at | NM_016424 | 263 | NP_057508 | 1014 |
| 17 | 9043 | UP | 206748_s_at | NM 003971, NM_172345 | 264; 265 | NP_003962; NP_758853 | 1015; 1016 |
| 17 | 4830 | UP | 201577_at | NM_000269; NM_198175 | 266; 267 | NP_000260; NP_937818 | 1017; 1018 |
| 17 | 4831 | UP | 201268_at | NM_002512 | 268 | NP_002503 | 1019 |
| 17 | 51096 | UP | 222038_s_at | NM_016001 | 269 | NP_057085 | 1020 |
| 17 | 1353 | UP | 214277_at | NM_004375 | 270 | NP_004366 | 1021 |
| 17 | 3131 | UP | 204755_x_at | NM_002126 | 271 | NP_002117 | 1022 |
| 17 | 58488 | UP | 218676_s_at | NM_021213 | 272 | NP_067036 | 1023 |
| 17 | 9772 | UP | 202650_s_at | NM_014738 | 273 | NP_055553 | 1024 |
| 17 | 57513 | UP | 221846_s_at | NM_020753 | 274 | NP_065804 | 1025 |
| 17 | 57513 | UP | 61297_at | NM_020753 | 275 | NP_065804 | 1026 |
| 18 | 8780 | UP | 202131_s_at | NM_003831; NM_145906 | 276; 277 | NP_003822; NP_665913 | 1027; 1028 |
| 18 | 8780 | UP | 202129_s_at | NM_003831; NM_145906 | 278; 279 | NP_003822; NP_665913 | 1029; 1030 |
| 18 | 29919 | UP | 221190_s_at | NM_013326 | 280 | NP_037458 | 1031 |
| 18 | 4864 | UP | 202679_at | NM_000271 | 281 | NP_000262 | 1032 |

TABLE 5-continued

Markers of the invention which reside in MCRs of amplification and display increased expression.

| | | | | | | | |
|---|---|---|---|---|---|---|---|
| 18 | 26256 | UP | 219928_s_at | NM_012189; NM_138643; NM_138644; NM_153768; NM_153769; NM_153770 | 282; 283; 284; 285; 286; 287 | NP_036321; NP_619584; NM_619585; NP_722452; NP_722453; NP_722454 | 1033; 1034; 1035; 1036; 1037; 1038 |
| 18 | 114876; 114876 | UP | 208158_s_at | NM_018030; NM_080597; NM_133268 | 288; 289; 290 | NP_060500; NP_542164; NP_579802 | 1039; 1040; 1041 |
| 19 | 7705 | UP | 200050_at | NM_007145 | 291 | NP_009076 | 1042 |
| 19 | 126231 | UP | 217627_at | NM_152360 | 292 | NP_689573 | 1043 |
| 19 | 8193 | UP | 206531_at | NM_004647 | 293 | NP_004638 | 1044 |
| 19 | 5714 | UP | 200820_at | NM_002812 | 294 | NP_002803 | 1045 |
| 19 | 11184 | UP | 214219_x_at | NM_007181 | 295 | NP_009112 | 1046 |
| 19 | 27335 | UP | 221494_x_at | NM_013234 | 296 | NP_037366 | 1047 |
| 19 | 27335 | UP | 212716_s_at | NM_013234 | 297 | NP_037366 | 1048 |
| 19 | 3191 | UP | 221860_at | NM_001533 | 298 | NP_001524 | 1049 |
| 19 | 22933 | UP | 220605_s_at | NM_012237; NM_030593 | 299; 300 | NP_036369; NP_085096 | 1050; 1051 |
| 19 | 4793 | UP | 214448_x_at | NM_002503 | 301 | NP_002494 | 1052 |
| 19 | 54938 | UP | 218702_at | NM_017827 | 302 | NP_060297 | 1053 |
| 19 | 6183 | UP | 210008_s_at | NM_021107; NM_033362; NM_033363 | 303; 304; 305 | NP_066930; NP_203526; NP_203527 | 1054; 1055; 1056 |
| 19 | 115290 | UP | 220233_at | NM_024907; NM_148169 | 306; 307 | NP_079183; NP_680474 | 1057; 1058 |
| 19 | 10298 | UP | 203154_s_at | NM_005884 | 308 | NP_005875 | 1059 |
| 19 | 10298 | UP | 33814_at | NM_005884 | 309 | NP_005875 | 1060 |
| 19 | 54623 | UP | 202093_s_at | NM_019088 | 310 | NP_061961 | 1061 |
| 19 | 10848 | UP | 218849_s_at | NM_006663 | 311 | NP_006654 | 1062 |
| 19 | 10849 | UP | 205264_at | NM_012099 | 312 | NP_036231 | 1063 |
| 19 | 80207 | UP | 206357_at | NM_025136 | 313 | NP_079412 | 1064 |
| 19 | 24139 | UP | 204399_s_at | NM_012155 | 314 | NP_036287 | 1065 |
| 19 | 2696 | UP | 208105_at | NM_000164 | 315 | NP_000155 | 1066 |
| 19 | 6633 | UP | 200826_at | NM_004597; NM_177542 | 316; 317 | NP_004588; NP_808210 | 1067; 1068 |
| 19 | | UP | 217661_x_at | | 1528 | | |
| 19 | 1760 | UP | 217062_at | NM_004409 | 318 | NP_004400 | 1069 |
| 19 | 25865 | UP | 209282_at | NM_016457 | 320 | NP_057541 | 1071 |
| 19 | 25865 | UP | 38269_at | NM_016457 | 321 | NP_057541 | 1072 |
| 19 | 29888 | UP | 217903_at | NM_013403 | 322 | NP_037535 | 1073 |
| 19 | 6510 | UP | 208916_at | NM_005628 | 323 | NP_005619 | 1074 |
| 19 | 1175 | UP | 202120_x_at | NM_004069; NM_021575 | 324; 325 | NP_004060; NP_067586 | 1075; 1976 |
| 19 | 1175; 1175 | UP | 211047_x_at | NM_004069; NM_021575 | 326; 327 | NP_004060; NP_067586 | 1077; 1078 |
| 19 | 2909 | UP | 202046_s_at | NM_004491; NM_024342 | 328; 329 | NP_004482; NP_077318 | 1079; 1080 |
| 19 | 728 | UP | 220088_at | NM_001736 | 330 | NP_001727 | 1081 |
| 19 | 8775 | UP | 206491_s_at | NM_003827 | 331 | NP_003818 | 1082 |
| 19 | 30846 | UP | 205341_at | NM_014601 | 332 | NP_055416 | 1083 |
| 19 | 30846 | UP | 221870_at | NM_014601 | 333 | NP_055416 | 1084 |
| 19 | 30846 | UP | 45297_at | NM_014601 | 334 | NP_055416 | 1085 |
| 19 | 3978 | UP | 202726_at | NM_000234 | 335 | NP_000225 | 1086 |
| 19 | 10945 | UP | 200922_at | NM_006801 | 336 | NP_006792 | 1087 |
| 19 | 83743 | UP | 221549_at | NM_031485 | 337 | NP_113673 | 1088 |
| 19 | 6141 | UP | 214335_at | NM_000979 | 338 | NP_000970 | 1089 |
| 19 | 1628 | UP | 209783_at | NM_001352 | 339 | NP_001343 | 1090 |
| 19 | 2523 | UP | 206109_at | NM_000148 | 340 | NP_000139 | 1091 |
| 19 | 2523 | UP | 211411_at | NM_000148 | 341 | NP_000139 | 1092 |
| 19 | 57664 | UP | 219011_at | NM_020904 | 342 | NP_065955 | 1093 |
| 19 | 4924 | UP | 200646_s_at | NM_006184 | 343 | NP_006175 | 1094 |
| 19 | 581 | UP | 208478_s_at | NM_004324; NM_138761; NM_138762; NM_138763; NM_138764; NM_138765 | 344; 345; 346; 347; 348; 349 | NP_004315; NP_620116; NP_620117; NP_620118; NP_620119; NP_620120 | 1095; 1096; 1097; 1098; 1099; 1100 |
| 19 | 2997 | UP | 201673_s_at | NM_002103 | 350 | NP_002094 | 1101 |
| 19 | 10856 | UP | 201459_at | NM_006666 | 351 | NP_006657 | 1102 |
| 19 | 3972 | UP | 214471_x_at | NM_000894 | 352 | NP_000885 | 1103 |
| 19 | 6625 | UP | 201221_s_at | NM_003089 | 353 | NP_003080 | 1104 |
| 19 | 27120 | UP | 220284_at | NM_014419 | 354 | NP_055234 | 1105 |
| 19 | 23521 | UP | 200715_x_at | NM_012423 | 355 | NP_036555 | 1106 |
| 19 | 57333 | UP | 219102_at | NM_020650 | 356 | NP_065701 | 1107 |
| 19 | 51070 | UP | 217950_at | NM_015953 | 357 | NP_057037 | 1108 |
| 19 | 3661 | UP | 202621_at | NM_001571 | 358 | NP_001562 | 1109 |

TABLE 5-continued

Markers of the invention which reside in MCRs of amplification and display increased expression.

| | | | | | | | |
|---|---|---|---|---|---|---|---|
| 19 | 3276 | UP | 206445_s_at | NM_001536; NM_198318; NM_198319 | 359; 360; 361 | NP_001527; NP_938074; NP_938075 | 1110; 1111; 1112 |
| 19 | 53635 | UP | 213690_s_at | NM_017432 | 362 | NP_059128 | 1113 |
| 19 | 23636 | UP | 202153_s_at | NM_012346; NM_016553; NM_153718; NM_153719 | 363; 364; 365; 366 | NP_036478; NP_057637; NP_714940; NP_714941 | 1114; 1115; 1116; 1117 |
| 19 | 7376 | UP | 218215_s_at | NM_007121 | 367 | NP_009052 | 1118 |
| 19 | 26085 | UP | 216670_at | NM_015596 | 368 | NP_056411 | 1119 |
| 19 | 55422 | UP | 219228_at | NM_018555 | 369 | NP_061025 | 1120 |
| 19 | 4849 | UP | 203239_s_at | NM_014516 | 371 | NP_055331 | 1122 |
| 19 | 79143 | UP | 205634_x_at | NM_024298 | 372 | NP_077274 | 1123 |
| 16 | 79042 | UP | 218132_s_at | NM_024075 | 373 | NP_076980 | 1124 |
| 19 | 6203 | UP | 217747_s_at | NM_001013 | 374 | NP_001004 | 1125 |
| 19 | 6861 | UP | 206161_s_at | NM_003180 | 375 | NP_003171 | 1126 |
| 19 | 51157 | UP | 220748_s_at | NM_016202 | 376 | NP_057286 | 1127 |
| 19 | 11338 | UP | 214171_at | NM_007279 | 377 | NP_009210 | 1128 |
| 19 | 29924 | UP | 221141_x_at | NM_013333 | 378 | NP_037465 | 1129 |
| 19 | 126208 | UP | 213402_at | XM_058999 | 379 | XP_058999 | 1130 |
| 19 | 55311 | UP | 218707_at | NM_018337 | 380 | NP_060807 | 1131 |
| 19 | 55311 | UP | 50376_at | NM_018337 | 381 | NP_060807 | 1132 |
| 19 | 9423 | UP | 205917_at | XM_375660 | 382 | XP_375660 | 1133 |
| 19 | 10794 | UP | 216273_at | NM_006635 | 383 | NP_006626 | 1134 |
| 19 | 57343 | UP | 207753_at | NM_020657 | 384 | NP_065708 | 1135 |
| 19 | 79744 | UP | 219826_at | NM_024691 | 385 | NP_078967 | 1136 |
| 19 | 79744 | UP | 58367_s_at | NM_024691 | 386 | NP_078967 | 1137 |
| 19 | 7693 | UP | 206182_at | NM_003435 | 387 | NP_003426 | 1138 |
| 19 | 10520 | UP | 205437_at | NM_006385; NM_198855 | 388; 389 | NP_0063763 NP_942152 | 1139; 1140 |
| 20 | 3397 | UP | 208937_s_at | NM_002165; NM_181353 | 390; 391 | NP_002156; NP_851998 | 1141, 1142 |
| 20 | 514 | UP | 217801_at | NM_006886 | 392 | NP_008817 | 1143 |
| 20 | 51012 | UP | 217851_s_at | NM_016045 | 393 | NP_057129 | 1144 |
| 20 | 5509 | UP | 204555_s_at | NM_006242 | 394 | NP_006233 | 1145 |
| 20 | 6874 | UP | 213090_s_at | NM_003185 | 395 | NP_003176 | 1146 |
| 20 | 26039 | UP | 213140_s_at | NM_015558; NM_198935 | 396; 397 | NP_056373; NP_945173 | 1147; 1148 |
| 20 | 5688 | UP | 216088_s_at | NM_002792; NM_152255 | 398; 399 | NP_002783; NP_689468 | 1149; 1150 |
| 20 | 9885 | UP | 209222_s_at | NM_014835; NM_144498 | 400; 401 | NP_055650; NP_653081 | 1151; 1152 |
| 20 | 3911 | UP | 210150_s_at | NM_005560 | 402 | NP_005551 | 1153 |
| 20 | 6227 | UP | 200834_s_at | NM_001024 | 403 | NP_001015 | 1154 |
| 20 | 10732 | UP | 204849_at | NM_006602 | 404 | NP_006593 | 1155 |
| 20 | 54994 | UP | 218448_at | NM_017896 | 405 | NP_060366 | 1156 |
| 20 | 54915 | UP | 221741_s_at | NM_017798 | 406 | NP_060268 | 1157 |
| 20 | 10139 | UP | 215984_s_at | NM_003224 | 407 | NP_003215 | 1158 |
| 20 | 84619 | UP | 221848_at | NM_032527; NM_181484; NM_181485 | 408; 409; 410 | NP_115916; NP_852149; NP_852130 | 1159; 1160; 1161 |
| 20 | 10139 | UP | 203174_s_at | NM_003224 | 411 | NP_003215 | 1162 |
| 20 | 84619 | UP | 57539_at | NM_032527; NM_181484; NM_181485 | 412; 413; 414 | NP_115916; NP_852149; NP_852150 | 1163; 1164; 1165 |
| 20 | 7165 | UP | 201379_s_at | NM_003288; NM_199359; NM_199360; NM_199361; NM_199362; NM_199363; | 415; 416; 417; 418; 419; 420 | NP_003279; NP_955391; NP_955392; NP_955393; NP_955394; NP_955395 | 1166; 1167; 1168; 1169; 1170; 1171 |
| 20 | 54963 | UP | 218533_s_at | NM_017859 | 421 | NP_060329 | 1172 |
| 20 | 24148 | UP | 208879_x_at | NM_012469 | 422 | NP_036601 | 1173 |
| 22 | 1652 | UP | 202929_s_at | NM_001355 | 423 | NP_001346 | 1174 |
| 22 | 2952 | UP | 203815_at | NM_000853 | 424 | NP_000844 | 1175 |
| 22 | 55000 | UP | 222244_s_at | NM_017903 | 425 | NP_060373 | 1176 |
| 22 | 55000 | UP | 212337_at | NM_017903 | 426 | NP_060373 | 1177 |

SEQUENCE LISTING (1528 sequences)

SEQ ID NO: 1 - DNA, 4860 bp, Homo sapiens
aacttgggggacccagcgaaatggaagaagttaggtgtccagagcacgggactttctgctttcttaagaccggcgtccgcgatggcccgaataaaggaaagagcttctacgtgtgccgggcagacacgtgcagcttcgtgcgggccaccgacattcctgtttcccattgcttattgcatgaggactttgtggtagagcttcagggtttgcttctgccacaggacaagaaagaatacagattgttcttccgatgcattagaagtaaggcagaggggaaacgctggtgtggaagtattccatggcaggatcctgattccaaagaacattctgtatccaataagtctcagcatgcatctgagacatttcatcattcttccaactggctgagaaatccattcaaggtacttgacaagaatcaagaaccagctctctggaaacagctcatcaaaggtgaaggtgaggaaaagaaggctgataagaagcaaagagaaaagggagatcagcttttcgatcaaaagaaagaacagaagcctgaaatgatggagaaagacctctcatctggcctggtaccaaagaaaaaacaatctgtagttcaagagaagaagcaagaagagggagcagagattcagtgtgaggcagagactggaggcacacacaaaagagacttttctgaaattaaatctcaacagtgccaaggtaatgagcttacaagaccatctgcatcttctcaggagaaatcaagtggtaagagtcaagatgtccaaagagaatcagaacctctgagagaaaaggttacccagcttttgcctcaaaatgttcacagtcacaactcaataagcaagccccagaaagggggacccctcaacaaggagtacacgaactgggaggctaaagaaacaaaggcaaaggatggccctagcatacaggccacccagaaaagcctgcctcaggggcatttccaagagcggccggagacccacagtgtgcctgctcctggaggaccagcggctcaggctgcaccagcagcaccagggctttccctgggtgagggccgtgaagctgccacaagcagtgacgacgaggaggaagatgatgttgtttttgtttcctctaagcctgggagccccctactctttgactcgactctggacttagagacgaaggaaaacctccaattccctgatcgaagtgtgcaaagaaaggtgtctcctgcctcaggtgtttccaagaaggtagaaccctcagacccagtagcccggcgtgtctaccttacaacacaactgaaacaaaagaagagcacactggcatcagtgaacatccaggctcttccagacaagggtcagaagttgatcaaacaaatccaggagctggaggaagtactcagtggtcttaccctttccccagagcaaggaactaatgagaagagtaacagtcaagtaccacagcagagtcacttcaccaaaactaccactggccctccccacctggtgcctccccaaccccttcctcgtcgtggtacccaacctgtgggttctctagaactaaagtctgcctgccaggtgactgctggaggatccagtcagtgctatcgaggccatacaaaccaagatcacgttcatgcagtgtggaaaatcacaagtgaagccatcggtcaactgcatcgctcacttgagtcatgtcctggtgagacggttgtggcagaagatcccgccgggctgaaggtccctttgctactacaccagaagcaggcattggcttggttactatggcgagaaagtcagaagccacaaggaggaattctggcagatgatatgggcttaggaaaaaccctgacaatgattgcgctcatcctgacccagaagaatcaagagaaaaaggaagaaaaggagaaaagcacagctttgacgtggctctccaaagatgactcttgtgactttacttcccatggaacactaatcatctgtcctgcctccctgatccatcattggaaaaatgaggtggagaaacgggtgaacagcaacaaactaagagtctatctctaccatgggccaaaccgggattcacgtgccagagtcctctctacatatgacatcgtgatcactacctatagcctcgtggccaaggagattcccacaaacaagcaagaggcagagatcccaggtgcaaacctcaatgtggagggcacctcaacacctttgcttcgaatagcctgggctcgaatcatattggatgaagctcacaatgttaagaatccccgagtgcagacttccatagctgtgtgtaagctacaagcctgtgcccgttgggctgtcactggaacccccattcaaaacaacttattggatatgtattcgctgctgaagtttctccgttgctctccatttgatgagttcaatctgtggaggagtcaggttgacaatggctcaaagaaaggaggagaacggttaagtattttaaccaagagccttttgctgaggagaacaaaagaccagctggactctactggcagacctttggtgatactgccccagcgtaaatttcagttgcaccatttaaagctttctgaagatgaagagactgtttacaatgtgttttttgcaagatcaaggtcagctctgcaatcctatctaaaaagacatgaaagtagaggcaaccaatctggaagaagccctaataatccattcagtagagtggcactggagtttgggtctgaggagcctagacactcggaggcagcagactcaccgagatccagcaccgtccacatactgtcccagttgctgagactccgccagtgttgctgtcatctttctttactgaagtcggccctggatccaatggaactgaagggtgaaggtcttgtcctttccctggaagaacagctcagtgctttgaccttgtcagaactccgtgactcagagccatcttccactgtttcccttaacggcaccttcttcaagatggagctttttgaaggcatgcgagagagcaccaagatttcatctctgttggcagaattggaggcaattcaaagaaattcagcatcccaaaagagtgtcattgtctctcagtggaccaacatgctgaaagttgtagcattgcacctgaagaagcatggactgacttatgccaccatcgatggctctgtcaatcccaagcagagaatggacttggtagaggcatttaaccactccagaggccctcaggtaatgctaatctctctcttggccggaggtgttggtctaaacctgactggaggaaatcacctctttcttttggacatgcactggaatccatcacttgaagatcaagcttgtgaccgaatttaccgagtagggcagcagaaagatgttgtcatacacagatttgtttgtgagggaacagtagaagaaaagatcttacagctccaagaaaaaaagaaagatttggccaaacaagttctatcagggtctggagaatctgtcaccaagctcaccttggctgacctcagagtcctttttggcatctaacctcctgtggataagggctcagaatagcaccattgctggtttgtattaggatctgggaataacaacctaaccatgagccttgaactctgttctttgcatttcaatttcaccgtcaagcctttcaccttcctcaaaatgaggcataatcttatccccagaattgaggaggggttgtgttaaccaattagttaaccaattatgttaataatttatttaatgagtggtatggaaaccaattgatttttttagataaaagaatatgttttagagttggatgattttggaaaacaactctggcagaattgtatataagcttcagtaaagttcaaaaagcgggccaggtgtggtggctcatgcctgtaatcccgacactttgggaggccaaggcaggaggatggcttgaagccagtagttcaagaccagcctgggcaacatagtaagaccccatctctatgaagaataaaaaaatgagctaggcgtggtagtgcacacctgtagtcctagctacttgggaggctgaggcaggaggatcccttgagtccaggaggttgaggctgcagtgagctgtgattgtgccactgttttccagcctgggcaatacagtgagaccctgtctcaaaaaaaggaaaaaaaagctcaaaaagttctgtgttgcctttctcttcttagctgatgatgggagaaccagttactaccttctctaacacaggctccatcctatctcttcatctcttcttgccagtgatgttgcacctgtaaccatctttttatgggtggagcagagagtcaatccctgcagccaccctgcagccagccatctctgcagttctctcagtgcaggcagttcttcctctcaggctgaagatcaaggagatgctttgtacatgaacagatgctgagtatctgttatcattgtattgtttagtgtcagtgtatcatttagtatttgtatcactgtaccatttagtgttgtatatcactcagtcatttaatattggttatcaccatacagtttaatatttgtatcatttggttcattgtatcgtttagtatttctattataacatttctatttgtagtatttgtataatatttgtgtcatttttaatagtatttgtatttttacaaatttgcagtatttgtagcatttagtatcattgtttcatttagtatttggtacaatctaataaatactaatccagtccaatactaatccaatccaatactaataatactattggtacaatccaatactaataatactattggtacaatccaatactaataatactaacagtagtattgatacaatctaataaataatgtgtttgacagtgtagcagaaaaaaaa

SEQ ID NO: 2 - DNA, 3850 bp, Homo sapiens
ctcgtggaggctgagattgcttcacctgtggtatcagacatcacaacatggggctcaccaagcagtacctacgctatgttgctagtgcggtctttggcgttatcggcagccaaaaaggtaatattgtctttgtgacacttcgtggtgagaaaggacgttatgtggcagtaccagcttgtgaacacgttttcatctgggacttaaggaaaggagagaagattcttatccttcaggggcttaaacaagaagttacttgcttatgcccctccccagatgggctacacttagctgttgggtatgaggatgggtcgatccgaatcttcagtctcctgagtggggaaggaaatgtgaccttcaatggtcacaaagcagctatcactaccttgaagtatgatcagctaggaggcagactggcatctgggtccaaggacacagatattattgtatgggatgtgatcaatgaaagtggtctgtaccgtctaaaggggcacaaggatgccatcacacaagcattgtttctacgagaaaagaacctgctagttactagtgggaaagataccatggtgaaatggtgggaccttgatactcagcactgctttaaaacaatggttggccaccggactgaggtatgggggttggttctgttgtcagaagaaaagcgactcatcactggggcctcagacagtgaactgagggtatgggacatagcttatctgcaagagattgaagacccggaagaaccagaccccaagaaaatcaaaggatcttctcctggaatacaagatactcttgaggcagaggatggtgcctttgagacggatgaagcccctgaggatcgaatcctttcatgcagaaaagctggttccataatgcgggaaggaagagacagagttgtaaaccttgcagtcgacaagacaggcaggattcttgcttgccatggaactgactctgtgctagaattgttttgtatcctttccaaaaaggaaattcagaagaaaatggataagaagatgaagaaagctagaaagaaagcaaaattacattctagcaaaggagaggaggaagatcctgaggttaatgttgaaatgagtctgcaagatgaaatccagcgggtgactaatataaaaacttctgccaaaatcaagtcctttgacttgattcattcacctcacggagagttaaaggctgtcttcctgctgcagaacaacctggtggaattgtattcactgaatccatccttgcctactcctcagcctgtcaggacaagcagaatcactattgggggtcatcgcagtgatgtgcggactttgtcattcagctcagacaatattgctgttctttcagctgcagctgattccattaaaatatggaacaggtctacactgcagtgtattcgcacaatgacctgtgaatatgcactttgctcattctttgtacctggtgatagacaggtagtcataggaacaaagacagggaagctgcagctttatgacttggcttcagggaatctgctggagacaatagatgcacatgatggagctttatggtccatgtccctctctccagatcagcgtggctttgtgacaggtggtgcagataaatctgtcaaattctgggattttgagttagtgaaagatgaaaatagtacccaaaagagactttctgtgaagcaaacccgaactttgcaactagatgaagatgttctgtgtgtcagttactctcccaatcaaaagctattggctgtgtctttgctggactgtactgtgaaaattttctacgttgatactttaaagttttttctgtcactgtatggacacaaactgcctgttatatgcatggacatctctcatgatggagcactcatagcaactggctccgctgataggaatgtgaaaatctggggtttggactttggggactgccacaagtctctctttgcacatgatgacagtgtgatgtacctacagtttgtacccaagtctcacctcttcttcactgccggaaaagatcataagattaaacagtgggatgcagacaaatttgaacacatacagactctggagggtcatcaccaggaaatatggtgtttggctgtaagccccagtggagactatgttgtatcatcgtcccatgacaaatctctgagactttgggagagaacaagggagcctcttattcttgaggaagaaagggagatggaaagagaagcagaatatgaggagagtgtggccaaagaagaccaaccagcagttccaggagagactcaaggtgacagttactttactggaaagaaaactattgaaacagtgaaagcagctgagaggattatggaggctattgagttgtaccgagaagaaactgcaaaaatgaaggaacacaaagccatttgtaaagctgcagggaaagaggttccacttcccagcaaccccatcctaatggcttatggcagtatctcaccttcagcttatgtattagagatttttaaagggatcaagtcgagtgagctggaagaatctctacttgtgctgcctttctcttatgtcccagacattcttaaactctttaacgaattcattcagctgggctctgatgttgaacttatatgccggtgcctcttcttcctccttaggattcactttggacagatcactagcaatcaaatgcttgtgccagtgatagaaaaattaagggaaacaactatttcaaaagtcagccaagtccgggatgttatcggcttcaatatggctggtcttgattatctcaagagggaatgcgaggcaaaaagtgaagttatgttttttgctgatgctactagccacttggaagagaagaagaggaagaggaaaaagagggagaagttgattctaacgttgacttagaactgaaatgtggtatcttttttttttcaactttttcctttaaaggactcctaaactaagcacagaagagttggcgtcatcttaaaaataccaaataacagaagatcgcattgcagatgatatcaggatgtggtttccagctttgcctgatggaattccaacatgagattatgggctgggctccatttcttggacttaaaatgcattattagtttaaaaactttctgtgctctcaaagcttgagccttgcagctcaagcttgttgttccctttatattctagcagggaataaataattgttttaattaggtatttgtttcattggagttgaaattaacatttcaaaagtttttcgtatttttttatggcagatgatttgtcatttatttatattaggttttactgcctattgagacaaccaggtgcataattgattgccctttggccataaaaatgcagtgtcatggatcttagagctaaaaaggactgtaaaaattacccagaacagcgtcctcagacttaaccttctgcaagttatgtctgtatataagaagattctaattgctaactgtttatacttttctgaataaaatagttgtttctaattaaaaagtagccaagctaagatgcctggctgggcttctgaggaattaatacacttcgtgtgtgtgtgtgtgtgtgtgtgtgtgtgtgtgtgtatgtgtatgtacacatacatatatatagttgacacttgaaaaatgcaggtggtaggggcactgacccacccctacgccccgcacagtcaaaaatctgcatataacttttgattccccaaagtcttaagtactagtagcctgttattgactgggagcctgactgatgtattatatatattgtatactgtattcttaaagtaagctagagaaaagaaaatgttacttagaaaatcataaggaagagaaaatatatttactgtgtttatcaatact

SEQ ID NO: 3 - DNA, 2277 bp, Homo sapiens
gactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcgcagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggacggtctctgcgatatgataccagctattttgtggagtattttgccttggatctcctgatggagaacggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtcgatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacagacctggtggagaccctggagctgcagaacctgatgctgtgtgcgctgcagaccatctacggagcagaggcgcggaaggagtcacggggcgcgcatgccagggaagactacaaggtgcggattgatgagtacgattactccaagcccatccaggggcaacagaagaagccctttgaggagcactggaggaagcacaccctgtcctttgtggacgttggcactgggaaggtcactctggaatatagacccgtaatcgacaaaactttgaacgaggctgactgtgccaccatcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgag

SEQ ID NO: 4 - DNA, 1148 bp, Homo sapiens
aatgccaggccctgcccccggcagaggcggaagcggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatatccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcggctaccggctctctgaccagttccacgacatcctcattcgaaagtttgacaggcagggacgggggcagattgccttcgacgacttcatccagggctgcatcgtcctgcagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtgtaaaaaaaaaaaaaaaa

SEQ ID NO: 5 - DNA, 2719 bp, Homo sapiens
ggcggcggcggcggcggcgtagccgtagaggtgcacagagaacacccctagcatgaacagtgtgaggattccaccagctttttcaccatgaaggagacagaccgggaggccgttgcgacagcagtgcaaagggttgctgggatgctccagcgcccggaccagctggacaaggtggagcagtatcgcaggagagaagcgcggaagaaggcctccgtggaggccagattgaaggccgccatccagtcacagttggacggggtgcgcacaggcctcagccagctccacaacgccctgaatgacgtcaaagacatccagcagtcgctggcagacgtcagcaaggactggaggcagagcatcaacaccattgagagcctcaaggacgtcaaagacgccgtggtgcagcacagccagctcgccgcagccgtggagaacctcaagaacatcttctcagtgcctgagattgtgagggagacccaggacctaattgaacaaggggcactcctgcaagcccaccggaagctgatggacctggagtgctcccgggacgggctgatgtacgagcagtaccgcatggacagtgggaacacgcgtgacatgaccctcatccatggctactttggcagcacgcaggggctctctgatgagctggctaagcagctgtggatggtgctgcagaggtcactggtcactgtccgccgtgaccccaccttgctggtctcagttgtcaggatcattgaaagggaagagaaaattgacaggcgcatacttgaccggaaaaagcaaactggctttgttcctcctgggaggcccaagaattggaaggagaaaatgttcaccatcttggagaggactgtgaccaccagaattgagggcacacaggcagataccagagagtctgacaagatgtggcttgtccgccacctggaaattataaggaagtacgtcctggatgacctcattgtcgccaaaaacctgatggttcagtgctttcctccccactatgagatctttaagaacctcctgaacatgtaccaccaagccctgagcacgcggatgcaggacctcgcatcggaagacctggaagccaatgagatcgtgagcctcttgacgtgggtcttaaacacctacacaagtactgagatgatgaggaacgtggagctggccccggaagtggatgtcggcaccctggagccattgctttctccacacgtggtctctgagctgcttgacacgtacatgtccacgctcacttcaaacatcatcgcctggctgcggaaagcgctggagacagacaagaaagactgggtcaaagagacagagccagaagccgaccaggacgggtactaccagaccacactccctgccattgtcttccagatgtttgaacagaatcttcaagttgctgctcagataagtgaagatttgaaaacaaaggtactagttttatgtcttcagcagatgaattctttcctaagcagatataaagatgaagcgcagctgtataaagaagagcacctgaggaatcggcagcaccctcactgctacgttcagtacatgatcgccatcatcaacaactgccagaccttcaaggaatccatagtcagtttaaaaagaaagtatttaaagaatgaagtggaagagggtgtgtctccgagccagcccagcatggacgggattttagacgccatcgcgaaggagggctgcagcggtttgctggaggaggtcttcctggacctggagcaacatctgaatgaattgatgacgaagaagtggctattagggtcaaacgctgtagacattatctgtgtcaccgtggaagactatttcaacgattttgccaaaattaaaaagccgtataagaagaggatgacggccgaggcgcaccggcgcgtggtggtggagtacctgcgggcggtcatgcagaagcgcatttccttccggagcccggaggagcgcaaggagggtgccgagaagatggttagggaggcagagcagctgcgcttcctgttccggaagctggcgtccggtttcggggaagacgtggacggatactgcgacaccatcgtggctgtggccgaagtgatcaagctgacagacccttctctgctctacctggaggtctccactctggtcagcaagtatccagacatcagggatgaccacatcggtgcgctgctggctgtgcgtggggacgccagccgtgacatgaagcagaccatcatggagaccctggagcagggcccagcacaggccagccccagctacgtgcccctcttcaaggacattgtggtgcccagcctgaacgtggccaagctgctcaagtagcctccgccggcctgccctgctcgcccctccacagcctcggtccctgcctttagaaacgcgggacagctgattgctctccttggccacacgtgctccttttagctgcacggcctgtctttaggtgccagtgtgatgcaccgggtgtgcgtcgagtgagcgtcccgaggccacgtgcggaggcccctcactgtgctgtcaaaggcctgtgggtgcagggctctgccgcacagcctctcttgggtgcttgtttgttgcagtggttgaaagtgtgtggggcacagaggacgtgcacctccctgccctcctcctccctgggccttcaccgcaccccatctgcttaagtgctcggaaccccgtcacctaattaaagtttctcggcttcctcagagaaatg

SEQ ID NO: 6 - DNA, 2355 bp, Homo sapiens
gggctccgtttgaaacatggcgcgggctggccctcggctggtgctgagcgaggaggcggttcgggcgaagagcggcttagggcctcaccgcgacctggctgagcttcagtcattgtctattcctggaacttaccaagagaagatcacccacctgggacattctctgatgagtttaacaggtctgaaatctttggatctctcgcgcaactccttggttagtctggagggcattcagtacctgactgcattggagagtctcaatctctactacaactgcatctcctcgttggcgaagtgtttcggctccacgccttaaccgagctcgtggatgtggacttccggctgaaccccgtggtgaaggttgagcctgactaccgcctttttgttgtgcacctgctccccaagctccagcagctggacgatcgccccgtgagagcaagcgagcggaaggcttcccgactgcattttgcatcagaggactcactcgactccaaagagagcgtcccagcttctttgaaagagggcagaccacaccaccccagagccaagtgcaccgaggccttggccaagcagagcctggtcatggatgcggatgacgaggcagtcctgaacctcattgcagagtgcgagtgggacctcggcaggcctcccgggagcacgagcttcagccagaaggggcgtgaggccgactctcgtggttcccaagaatccagacatctgttgagcccgcagttggtacagtaccagtgtggggactctgggaagcagggccgtgagacgaggaggagcagctgcagagggtgctgtctggagaagatgccttggagccagctctgtggagagcttccgccactgtacggagcggagccagaggcctcccgtgcccccaggccacacacgtacttcaccccacacccagactccatggataccgaggactcggcctcttctcagaagttggatttgtcaggagaaatggtgcctggtcccctgccagcccccggaaagtgcaggaagcgaagaatgcctgttggaagattccagacgttttcggaccaggagggtttgggctgcccggagagaactcatgggtcctccgtgcccaaggagagcctgagcagacaggacagctcagaaagcaggaacgggaggaccttgtctcagcctgaggcctcggagactgaggagcagaggtctcggggtgtgaccgacaccagagagccgtctcccgggtcacactcggctctacccgggaagaagacggccctgcaggcggcgctcctggagacgctcttggacctggtggacaggagctggggcggctgcaggtccctgcacagcaacgaggcattccttgctcaggcaagacacatcttgtcatctgttgaagaattcacagcagctcaggacagctctgcgatggtgggtgaagatgtcggctccctggctctggagagtaagtccctgcaaagccgccttgctgagcagcagcagcagcacgcccgggagatgagcgaggtgacggcggagctgcaccacacacacaaggagctggatgatttgagacaacatttagataaatctttggaagagaacagtaggttaaaatcgcttttgttgagtatgaaaaaggaagtgaagagtgcagacactgcagccacgttaaatttgcagatcgctggacttcaaacaagtgtgaagaggctgtgtgtcgagattgtggaactgaagcagcacctggagcactacgacaagatccaggagctcacgcagatgctgcaggagagccacagctccctggtcagcaccaatgaacacctgctgcaggagctgagccaggtgcgggcgcagcacagagccgaggtggagcagatgcactggagctaccaggagctcaagaagaccatggccctgtttccacacagcagcgccagccatggaggctgccaggcctgctgactcctgccgagaagctgggccaccccttaagcttcctggtaaagttacattgtctgcacctttgtacttctttattgagtgtactggctggcaagagttctctcttctgttggtaattatttaggatttttggaatgtattcaggacctgtagcttggttttctaaagcacctcgtaaaatgatatgattactccaagccctctgcatgttttcagacagaacacattgacatattttgagacaaactgactattaatcttgtatccagtatcctgagatgaagtaaatgcagtgttctactgcctgatgtgaaagagagctatgtatgataattaaagaaaataattttctgtgtaacaagcaatctttatttaataaacaaatacattgttctg

SEQ ID NO: 7 - DNA, 4889 bp, Homo sapiens
aggtatttactttttgttgaattttaagggacctcaagtgaaataataatcggtgaattcaggatcaacctttatgtccagagcgtttgttccgtcgtccatttcttgtctagagtagtggtatgagctgaaaacattgctaagtgatcaccacatattgttgatgtaagggctactggttattacaagagatttttatgactcctgctgtgggggtgccctttctacccggctgagcttggtgggagccaaggctgagtcggatgtatctttatattcccagttctcggtggaacttaaaatgctgtgagacaccagacagacagatactgtgaacttggagctctctaatgaagggataccaaagtcttgtattcaatttttttttccttaaattgtcagccgaaaatgagagcacacctattcagcaactcctggatcacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaaggtagtgctctgtggccaccgagagagggtgccacgtggccccagactctctgtgtgcctctccttctgggttggtgctgtgtgatctagcacagccaccgggatccagaggtcagcgtggggccctgacgggaggtccggatcagacacacataaggctggtctcttcagtcggggtccaggtgcctctggcagggctgccgctggtgtttcatgcatcgtggaggccacgtggtcactgacctcatttccttgatggaggccctgctgcaggctaatcctttctcttggagtgaatgctgacttctgtgtctctgtcactgggtgttgacgtgaggcaccgcccttgttattccagtgggggtgctggtgttggatccgacagatggtccataataggccaccgactgtgttcacgtggctcctgccacagatggtctttgtggtggtggggcccactcagctgaccacgctctcctttctggcaggagacgttctagacccagtgtcttcagtggaaacagagcacaggctgtctgcagtctcaggcttcctagcagccctgataagagaagtagagcaatgcaggtgacattaatccttgcaggtttcatttcacctctatatccaacattttatctcaacatgtagtctgtagaaaacgttaatttgagctttatgggtttttttcatattaagtcttcaaaatgcacatgggatgggatgtaaagaacgctgaagtgggggcatttcagaggtgtctgctgctttttgcctgtgcctgctgggaagttgcagtgctctgtgtggcttgcgtgttgcgaggttgcggtctgcgtggctcacgtgttgggaggtcgtggtctgcgtggctcacgtgttgggaagttgcagtggtctgtatggcttgcgtgttgggaggttgcagtctgtgtggcccgtgtgttgggaggttgtggtctgcgtggcttgtgtgttgggaggttgtggtttttgtggcttgcgtgttggggggttgtggtctgtgtggctcacgtgttgggaggttgtggtctgcgtggctcacgtgttgggcagttgtctgcttggctcacgtgttgggaagttgtggtctgcgtggctcatgtgttgggaagttgtttatgtggcttgtgtgctggaggttgtggcctgcgtggctcacgtgttgggcggttgtctgcttggctcatgtgttgggaagttgtggtctgcgtggcttgtgtgttgggaagttgtttatgtggcttgtgtgctggaggttgtggtctacgtggcttgcactgtagttcttttggacagccttgctctgcagtctgtgtttcagccctggaattgccacattctccaagaagccctggtttcttgactagagagccttgtgtagaagccaggacctgggttctgggtgaagccctctgcagatagagctgggagatgcctgttgtgtgtgtctgcaccacatacatggacactgtgcagagggattctgttggcacctgtgtttacatgggttgaaaactgtttttacacggaaacttccagttccctcgtgccccgtgggttccgcccacttcttccctttcagttttgtatctgcgccgtgaggacttgtctcctaatcttcgtatcaactccgtgtcccattgagctgaccttccgcctctcccccagggccctggccatcctgtgggctctgagactttgcatggatccgcggtggggagctgcccccacacaaacgtccggctcttctcaggccaggtggctgccctgacatggcatgatgtccagcgcatggacgtcacccttgcactggagcccagccaaccgctgcatgacagccctcttcccccttgaaccccaagtctgcacacaccagtgcctcctcttcctggatcctcctgatggcctgtacacagaactggggtgtgggtggtgggtttttaaatgaaaaccagtccacacatgcttgagggctggagccgcctgccgtcagggcagtgccatgctgacctgctgaccgttccattttgtcaaggctcatgagcaattttaaatgtttactcgtgggtgaaggtttttgtttcagctgtaccccctatagcagggccatggggagcctaagaggttctccttggcacctgtgcgcgctctgctgttgccggtgagtctgaaattccagggaatgccgtgaggggccctctggcgtttgttcttggacaaatgtgctttcacccccattaagccctgcttgttggtcttcatttcatttgtgctgcgctgcccctcctgagggacagacgctcaggcagtgcttccttccagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttatttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactgggaaaaaaaaaaaaaaaaaaaac

SEQ ID NO: 8 - DNA, 3994 bp, Homo sapiens
gcccgctccagccgccgcgcatcctcggcccgcgccccgagacccgcgcccagctagccccggccccgctcggcgccccaggcagctcggctgcgctcgccgcgggacggcgcggccatgaggctgcggggatgcggaccccgggccgcccctgcctccagcgcaggggccagcgacgctcggctgctggcgcccccggggcggaaccccttcgtgcacgagctgcgcctcagcgccctgcagaaggcccaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagatgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtcacgcagccacccgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatggatgtttgttcctcctgattctcttttctcttcgtggcgacttagagttggcggatattcggaactgtgaatgtacatagcgttgagttaaaccccttgtgtgtgagacaggacgcagcgggcccctggtggcctgggggccagacccgtgggcaggtggggcatgggccctggcctgcggggacctgctggggtgtgagggcagagggagggttgccatgaaggaacttgggattttcaatggaataagtaaaacataaagtctatacttgggaaaaaaaaaaaaaaaaaaaaaaaaaaaaaaaaaaaaaaaaaaaaaaaaaa

SEQ ID NO: 9 - DNA, 750 bp, Homo sapiens
gggtcaaaggccagcggcgcaaaatggcggcggcgatgaccttctgccggctgctgaaccggtgtggcgaggcggcgcggagcctgcccctgggcgccaggtgtttcggggtgcgggtctcgccgaccggggagaaggtcacgcacactggccaggtttatgatgataaagactacaggagaattcggtttgtaggtcgtcagaaagaggtgaatgaaaactttgccattgatttgatagcagagcagcccgtgagcgaggtggagactcgggtgatagcgtgcgatggcggcgggggagctcttggccacccaaaagtgtatataaacttggacaaagaaacaaaaaccggcacatgcggttactgtgggctccagttcagacagcaccaccactagagcgtgtggcacgccgggggtcccgcagcatcctgtgagcatttccgcggggaagctgagcacgtgaagctcgctggttctgtgcgaagggtattcctggtgctgaataaagggtgttgctgtcaaggctgacaatttatatctgtgtgaggctggattttctttgcctactccaaccaaagcgacacatcacagcagactggatgcagaagcgtgcgtgggaatgcagctgttttccatggaaccagacgctacagagactgcaacgtgtaaaacactgccattcttttcattcctttgaataatttttttaaaatttgctatttaacacgtaatagttttttattttaaa

SEQ ID NO: 10 - DNA, 7673 bp, Homo sapiens
atgggtagacaaggtggcgaacgattcaaccaggctctgggcttggcgcatggtgggcggtggcgcccacacctgggcctgggaacccgccgctcgggcatcactggctgccgcggcgaccggcgaggacacatgaccgaggagcgaaagtgcctgaggcagctctggctcggagagccttttgctagccccacggggacctctgtgcacggatggacccgcccggacctggcgggaagcggcctggcaggcggcggccccggcggcatcagcagagacaggacggggccgacgccgcgggcccctgaggcagagaatagtaatctgcatcaccaagtggaagagatgcttcaaaaaatttctcctctacagaaatgtcaggaagaactgggatctttaaaagcagagctagaagagaaaaagagttctttaaagttgtatcaggatactcatcaggaatatgctcgtgtaaaggaagaatgcttgaagagtgatgctcagaagaagaaactagaagctaaggtgaagaagctgcaaggaaaagtgaaactgcttctgaaggaactctggctctgtgtaaacacaacacacagactacctggtgaaggcagcaggtgtgtcccagaaaaacctgccaaagcaatcaccagctccagagtgcctggggaagatggtacgctacctccaacacagggcagccctctcaggacctcaaatgtgcagacatgcctcacaaaactgtccatggagataaaggaggactttttatgtcaaaatgtggaaaaacagagctccagtggaacaaattgtagttctgaccatgtttttaatgagaatggaaatcttgaggttttagtacaaagtcatcgtgacggtggtagtactgaatttgttgatcatgatcatttttttgatgaagatcttcaagctgcaattgacttcttcaaacttccccctcctcttctgtcaccagtgccctcgccccctccgatgtcatcacctcacccgggttccttaccgtcttcatttgcacctgaaacctactttggagaatacacagattccagcgataatgactcagtccagcttagaaattctgctgagtgtgtttcagaagatgatacaactgaatcacagaattattttggctcattgagaaaaaataaaggaagtggcacatgggaggaaaagcccaaatcacatgaagctatccaagctctgaatacatgggaagtaaataaagtgacaacttctggactcgagactttcacagcaacactgagagaatcttctgccacacactccttagttggtgaaaaacactggaccacagcatctcgatccatgagtgatagaaaaagagacattttacatgagacaaaaacacaaatggaggttagggagatggataagtcagtacaaactgagaagaccattcataaactcactcgaggtctatgcattgagagattgtctgccagccctgcacaagagaaggaagctgcccctgggaagtctgagttgtgttcttctccccttggcaaaaggccattaaatgaactcatggaatctgaaggaaaaaccgtattgtctaaaatgatgggatcgcccaaatcagagtttactaagtggacacgaattaatgaaatcacttctgaaccagaccgtatcacagtttctggccattttcacagactatctagagaattggaaaaggaaaaagaagatactcaagggttcactttaggagaatcacctgaatcagaagatgatgactcaggtgatggaatggatgtagcagggcttgacattgaaaccagtttttcttcctcttctaccttggtagcattgtctgttggcagtaatccccagtcttcttctgggttagactgtggtaatgatacagatattactactaaagtattctctactgaaccgcatcattcagaacataaattgcaaactaaaactttaaacacattacatctgcagtctgagccaccggagtgttctataggaggaaacaacttggagaatagcttgtgtgccttgagccctgaattgggagcatctaattttaatgatcagaagagcagtgggatagaatatacaaaagtagtaaaaggcttgaccaaaatacattcacttcctcggtcagtatttatgaaagctacaaaagatgggcaatgtgaaagtcaagatccaagaattgagctcacactaaataagccagatttcacatcattaataggttctcaggctgccttgatcaagagtggtttgggttttgttaaaagtacttcatggcaccatagtgatttattaaggaaaggtggcgaagaaagtctgagagccaaatcagaacatgaacagaagactagccatcagttacaaaaggcaatgccattcctacaaaatagaggaccaacacccaagcctgatcttcttagagaaaataacaatcctgtagaattcaagaccactgcatcggtgttgcctaatcaagtatcagttatcacaaaacagacaagacctgaaaaggttcagagtgccaaattggaacacttgaggccacatagggttgagcctaccttagtaacagaaaatagtggcaacaaaaccggtatgtcaactgtagcaaaatgtgatggggaaagagatgatacaacacaaaacatcacggaggtggctgctgtgaaaagcatttcaccagaagtttctgcctctaggagaaaattagattttaattctccaggtggttcttcaccagtagaaaattctgattgttccacaaatagcagattatctttctctcctgaaaatatcctcatccaaaaccaagacattgtgagagaagctgcagtgcagggagatgggcagaagcaaaggcagcctcaggccacagatctggactccagtgggacacatggcagtgagatgcttccagccacagaagtgactgtgtcaggagggttttctgttgaagaaaccagctgtggagacacagggagatctggtggtgaggccctggctgttgcaaatgattctaccagcacaccacaaaatgctaatggactttggaaattgaaatctacaactcccggtggtgctttgcctgagtgttttggcaccacagacactactttttcttcagcattttgcagaaaacatggagagacacaggatacctcccaaagtagcctgcctggtaccttacattgttacacaggcattcgagaggggggagacgacactgaggtagagagtgaggcatttagctgcagtgaggggagcgaacagcaagatgctcctgatgactcacagaaaaatttaggagacacagatgctgctgtagccgaggtgagaccttccttagaggtaggttatttgacgtcagctctgcaagattttaacataagtactttttctgagctggatagactttccacatcagaggttgtgatgtttcttgagagctgtcagttaggggattatagttcaggggactctgtttctgaatgttctagtaaaggaaccctaagtaaagaaatgaacaaagaattaaaggcaagtgaaataggagaaaaatacagaaagcaaccctgtgaggaagaaacacttggaacctgtgaagagtggattgaatcagaggaagatgattattcgttaaaaaatacaagtcagctcactcagtgttctttggaaactctgtctgaggttctgaccaagattaggcaagaacttcaaacaaattctgaagattgcaatggtaaagatactggcagtttattgctcttaaatgtaaataacaacatgaccactgagaatttaaaagagaaaagtccatttcgggaaacgactggctcctcatcacatgcttcagaaccaaccccacaagcagctgccttggacactgagggcagctctcccatcagcggtatgcctcagaatgaaaaccctcagagcagaccagaggcccgttcagatgcaggcaggcaaaccgatggtggggaagaagacctgccagaacctgtggagccatcagccttgtgctctgactctgtgatggagccatccatagagcaaagttctaactgcgaggccgaaacaacatttcagtgtcagatagcaacagtgacctcagaagttataaacgtacttataaataaggatcagaatctagtcattgaaaagggggacaactggacaatcatcagtggtgtagctgtcttgccacatgtggaccaggtcacactgtgtgacattcctggagacatccctatttctcaggatcaaggagagctggaagctggttgcatcccagtgacttctgctgagaagtccccagaggccagtcacactggccctgcatttcaggaggctccatgtggcaataatctttcatgtccccaagaggatgtttcaagcagtggtcagagcaccaactttgataagagtcgtttgcgaaatagacccgttaagcctagtatatggattagttctcaaatctatgatcaaaacttcgagactcagattgttgcgtctgatcacacatattataactcaaaactagagccatctggcaaaaataagaatcgatcaaagatttcaaacaaagatcagtcaaacaaaccagtaaaaacttcagcgtcgagcagagttgaaactcatcagagtgaagttgctcagtcattttcaggggaaaaagctaatacaaaaactcaaagaagccaaactcagaccattttagcaaatgctgatacatccactcctacagattgttctcctgacacactgagtaaaatacggcaagaggtggggcctcctttgccgcctctgcttgctcctctgatagctacacctccaaggacttcacagccactgtctccactgatatcgagttctagtccttcctcaccagcctctcctgttggccaggtttctcccttccgtgaaaccccagtgcctcctgccatgtctccatggccagaggaccccagacgtgcctctcctccagatccttctccatctccatctgcagcttcagccagtgagagggtagtgccgtctcctctgcagttctgtgcggccacgccgaagcacgcacttcctgtgcctggccgactcccaccctgtgcatctggccacgctgctgtgggagggcctcaggagaattctgtgaaaatccttgacaccatgtatccagagttatctgccagggcccggaccctcaacatcctcaaagggaatattcaactcacacgaggtccgcctgctgactgtaagaatttaccgggacctgccagtgctatgataggattcaaaacgatcacttcagcagcaactgcttttgtcaaaactgggagcagctctggtggtgactgtaaccaagacaagtcaagagatttggggactcagcaggattcaagcgggaaaagaacactgtcaacgtctacactgagaagtgctaaaagactgcgcctggacactgggtccccagaaccagaaaccaggggagtcactgcagaaggaatccacaaaaacctcccagggaacctccctccagctgaagttgcaacaacaaatgaggaaagaagttgttctagtccagccgtcagtgcagtttcacagttgcctttaagcccaaaagaaactgtggagtcccatgataaagccatagctaatgccctgaagaaaattgcagagttttcttttgatctgttacctgtcattcgtagtcatgtgtatgtgggaaatatctccaaaaagcccgtaatgagagatcaagagaaggaagttgtttatgaatttagcacaacaaaaaagcatttagcagagtgcttgcttcactctattctctcagaactaaaaattcagaagatatctatggaccacaattacattcacgccctctgcagggtgtatgtgggtatttgtcggcaactcggagacttggaaagagctcgtttgttttgctacagcctacttaaagaagattttccggagtctgaaaaattaactttgtttattgcaaacatgtggcatgatatatttctctctcaatcggtgattaataaagcaatgcagttagttgccaggcaacgtgctaaaggagaggttctgaactgcttgagagcttttcttaattgggaaaagaatgccccggtagatgttggcttcatggtttctaagctgcttttgaccatacagttatgtccaaaaacagaatttcaacctagtgaaaaatttggtgaagacctaagtgataacacttgggaatacatatttgccattgatctgctctgctgccatcagaaatggatctggacgcatgataacatcataagtaaggagctgtggcctgtgatggataaatggataaaatacagaaaaggacatgcaaacattgcgtatactcctgatattattatagcctcaatactgaggctgattggtcgtttaggccaattgggtttgaaagaaggatttccatctgctgtgaaaaatattagttcggttattggtatgtttatacagcatgctcacgatgaagatataccatggggtatacagttagcagccgtgtatgctctttgtgacttgagtcccagcaatccagcagaaatttccaagatcctggaagcttggcggagagaggcctccaaaagcgttccgtctgcgattgtcagctgcctagaggaagtcagtgccctgagcacagaggagcttggctgacctgggatgccactgaggcttgagaagtgccttgacacattttgaacacaaatagtttgatcagctttcagaatacaaagggaggtttcaaaacaaaaagacataaaatagataaaacagaccagaggctctccttattgtttggcaaggagacaggagaaacaagcagtcgcatagtcgtttttccctaaatctaatacgtttcacttaaggctgttgtgatctgtgacatatgggttatattattgtgtctttgtcaaacaacaaaaacttgaacttagccctttttttgctgcagaaagtgtccttttagtggcttcttaaaattgagtggcattttataatgaacttaccaatataaaaacatgatttggttcctgagctgttgttgttggacttgtgttccaatgagtgactaggaaaaaataaattggcaaaaacctagagttttctgctatctttgctggaaatgagttgcaaaagtttttctcaagatgtagtgcgtaattgatcagagcaaaacatgcagagcccttagcagaaacccactttaatgcattttcttcatatccctaaagttccttaaaaatatgtgacaatgcatcaggaagaggagaactgaagagtagaagttcccttgcagatttttttatcagtgacatgtaatgagcaattcacagatgagcgcaggcagagctctgtgtgccgtgtacatatggaccgtgctatgatgtgtctcacattggatgatattccactttgggaattttagtatttgtatatagaaaatgggtttaataactcaccatggttttgatttgtcttatattcgttatttcttaaaactcttgtatgtgtttttataataaaaaataaaagtaagccatggatattactgttctgattaaacaaacaaaaaaaaaaaaaaacaaaagaaa

SEQ ID NO: 11 - DNA, 13268 bp, Homo sapiens
ggtcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagaggaaagggaggaggagtccccgcccaggccaagcctgtcccagcccccacggcggccttggggcaacctgacggccgagctgagccgtttccgcggcacggtgcaggacctggagcgccacctgcgggctcacggctacccactgcgggccaaccagacttacacgtcggtggcgcgccacatccatgaatacttgcagcggcaggtgctgggcagttccgccgatggcgcgcttctcgtgtctctcgacgggctccgcggccagttcgagcgcgtggtgctgcgctggcggcctcagccgcctgcagagggccccggcggtgagctgactgtgccgggcaccacgcgcaccgtcagcctgcccgacctcaggcccggcaccacctaccacgtggaggtccacggggtgcgggcggggcagacctccaagtcctacgccttcatcaccaccacaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccacctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggacgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagaggaagagacccccagccccacagaacccagcatggaggccccggagccccctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtatggcctccacgaggggcggcgcgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctgggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggaggaagagacccccagccccacggaactcagcactgaggcccgggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacacggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacaggagcaataaaggagaaactgaggtacccgg

SEQ ID NO: 12 - DNA, 3129 bp, Homo sapiens
ccttgtgcatttgggctgaagacaaagatgactgcaggagtgggcaggccggagtggggcgccctggcctgtccccaggaaggaggaggagtctgcagccctgtgggcttcaacatccatcaaggagtccagagcaggagccaggccaggcgggagggaaaggccctgggaggggctctctaatctcccagccccgactctgccccgtcactgccactgctcctcattactcgctggggctgctgtcgcctccccgaagggtggccttgtccagatagcggcaaacctccctgccgtggatgagtcaggagcattttcttaagaggaacatcactggaaaacaaaatgagcggggacacagaaaccaacagcagtggctgcatttgtggtacaggctcctcttccagagctcgctgatgcccacctcagacaggcctgaccacggcacggctggtgggatttgccagtcacctcaaccagccagttccaccctcagcttctctcagaagggagcaccacactcctcaagctcagtgaatgtatcccggcatgggtggggccagagcctgtgatatctcgaggtgggctcggcaggacaccggggtgtggaagggggaagcgagcacctgactcagacagcgcgggagctcgcaggagtcacgaggccacagcgacttcattgtctgactgggcctggacctataaacttcccacctcagccttgggccaagcctggaagataaaaatggagcaccccatggcgcccctcactcagattctcccctgggcttctcccacgcagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacacggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacaggagcaataaaggagaaactgaggtacccggaaaa

SEQ ID NO: 13 - DNA, 1720 bp, Homo sapiens
cccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtcggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctgaaaaaaaaaaaaaaaaaaaaaaaaa

SEQ ID NO: 14 - DNA, 1593 bp, Homo sapiens
cagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctgaaaaaaaaaaaaaaaaaaaaaaaaaaaaaa

SEQ ID NO: 15 - DNA, 2975 bp, Homo sapiens
gagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaaaaaaaaaaaaaaaaaaaaaaaaaa

SEQ ID NO: 16 - DNA, 2871 bp, Homo sapiens
gagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaaaaaaaaaaaaaaaaaa

SEQ ID NO: 17 - DNA, 2649 bp, Homo sapiens
gagacgccgagcgggccgagtgcggccgagcaaagccggagccggagcggggccgcaggagacgggccgggtccggacgggccgagatgccctataaactgaaaaaggagaaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaaaaaaaaaaaaaaaaaa

SEQ ID NO: 18 - DNA, 2776 bp, Homo sapiens
ggaaaacgacacctagaagtaggagtgagattcgctgaagttcccttctgaggaagacccacccctccgcctggagagccggggctggcggtgcctgaggaccccttcggcctggacagcccacgcgggcttggggggcctcgctctgccctcatggggcggccatcggttcccgaagcggcgagtgaaaattcaaatggccagtagggggcgcactcggaagtggccgccccgcatgaggcagttcagcggccccgagagtccggggagggaggtttattctccgcctgcacgagactgtgaaatccgcaaccatgagcaggagaggcggccctggtggggaagaggccaccaacatctggacggcaggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggcgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaaaccccctcatctacagctttctcggggagaccttcagggacaagctgaggctgtacattgagcagaaaacaaatttgccggccctgaaccgcttctgtcacgctgccctgaaggccgtcattccagacagcaccgagcagtcggatgtgaggttcagcagtgccgtgtagacagccttggccgcataggcccagccagggtgtgactcgggagctgcacacacctgggtggacacaaggcacggccacgtcatgtctctaaactgcggtcagatgtggcttctggctcctcggggcctcgcgagggtcacgcttgcctggtcaccctggggctgcttaggaaacctcacgactggtcaccttgcactcttcacacagaattgctacaatcccaaagcgctcgccccgcagggtccaaaggccagcggtgaccagcctgtcacccagctcctccccgccaaccctgcctgccgctgcacctgcctgccgctgcaggaaacatttgacaccgtcgaccaggaaagccacacggagaggccactgtgggtgaagcgcctcagttacacaggaaccctaaagcaaatctgccaccgtgggggaactgacgctggagatgcaaggtgctggtgggtctgagctggacgtcgcggtgtgtcctctgtgcccacggtctgagctagctagcgcaccgccgagttaaagaggagaaggaaaacatgctgctctggtgcacgcctgagcgtcctccatcttccaggatggcagcaatggcgctgtgcggcctcaccaggcccacgaggagcagcagcgctcggcccggagcagcaggaaggcccctctgtggagcgcccgccgtctgctccggggtggttcagtcactgcttgttgacatcaacatggcaattgcactcatgtggactgggaccgtgcgagctgccgtgtgggttagtcgggtgccaggacaatgaaatactccagcacgtgtggctgacgaatttgtttctacagaaataacagctggggacaactgcggtgatgatgtaaaaaccttcccataaaatgtaagaaaagctgatgaggctggtgacgttcagcctttgtcaataaacctgtcatgtgcggatcctt

SEQ ID NO: 19 - DNA, 2776 bp, Homo sapiens; identical to SEQ ID NO: 18

SEQ ID NO: 20 - DNA, 7185 bp, Homo sapiens
atgtggttaagtggcaaaagccaggtgcagaaaagaggagccgtgcgctacctgcaggcaccacctgtgaatggagaggccagcgcctgccccgcgccgccgacccacctggaccggaccacatgcgcgcggcgccggccagcccgcctcccgccgccatggggcgctgcaggcatcaggccggcgccgcgggcctctcgcgcctccttctgggcccgcttcccgccgcactgttttccttccggttgttccggaagtcgggtcctcgagggcggtgagatcggtttccgattccggggtggccgggtggcggcggcggcgctccggtcgcgatgggccagaggtgacgccgcagccgccgggagccgcgagggacggggcaggatgaaccgggccaagcccaccacggtgcgccggcccagcgccgcggccaaaccctcagggcaccctcccccaggagacttcattgctctgggctcaaagggtcaggccaatgaatcgaaaacggcgtccaccctgctgaagccagccccttccggcctgccttctgagcgcaagcgggatgcggcggccgcgttgtccagtgcctcggccctcaccggtctcaccaaacgccccaaactctcctccacaccccctctgagtgccctggggcgcctggctgaggctgcagtggcagaaaaacgagccatttctccgtcgattaaagagccatctgtggtgccaattgaagtgctgcccacggtgctgctggatgagatcgaggcggccgagctggagggcaacgatgacaggatcgagggcgtgctgtgcggggccgtgaagcagctgaaggtcacccgcgccaagcctgacagcaccctctacctgagcctcatgtacctggccaagatcaagcccaacatcttcgccactgagggcgtcattgaggctctgtgtagcctcctgcggcgggacgcctccatcaacttcaaggccaaggggaacagcctggtgtctgtgctggcctgtaacctcctcatggccgcctacgaggaggacgagaactggcccgagatctttgtcaaggtgtacatcgaggactccctgggggagcggatctgggtggacagccctcactgtaagacgtttgtggacaacatccagacggccttcaacaccagaatgccccccaggagcgtgctgctgcagggggaggcgggccgcgttgcgggcgacctgggtgcagggagcagcccacacccctccctcacggaggaggaggacagccagacggagttgctgatcgcggaggagaagctgagccccgagcaggagggccagctcatgcccaggtacgaagagctcgcggagagcgtggaggagtatgtcctggacatgctgcgggaccagctgaaccggcgccagcccatcgacaacgtctccaggaacctcctgcggctcctcacctccacctgcggctataaggaggtgcggctgctggcggtgcagaagctggagatgtggctgcagaaccccaagctgacccggccggcccaggacctgctgatgtccgtctgcatgaactgcaacacgcacggttccgaagacatggacgtcatctcacacctgatcaagatccgcctcaagcccaaggtcctcctcaaccacttcatgctgtgcatcagggagctgctgagcgcgcacaaggacaacctgggcaccaccatcaagttggtgatcttcaatgagctctccagcgcccggaacccgaacaacatgcaggtcctctataccgcactgcagcacagctcagagctggcgcccaagttcctggccatggtgttccaggacctgctgaccaacaaggacgactacctgcgggcctcgcgggccctgctgcgggagatcatcaagcagaccaagcacgagatcaacttccaggccttctgcctggggctcatgcaggagcgcaaggagccgcagtacctggagatggagttcaaggagcgcttcgtggtgcacatcaccgacgtcctggccgtgtccatgatgctgggcatcacagcgcaggtgaaggaggccggcatcgcctgggacaaaggagaaaagaggaacctggaagtgctccgctcattccagaaccagattgccgccatccagcgggatgccgtctggtggctccacactgtggtcccctccatcagcaagctcgcccctaaggactacgtgcactgcctgcacaaggtgctgttcacagagcagccggagacctactacaagtgggacaactggccacccgagagtgaccgcaacttcttcctgcgtctgtgctccgaggtgcccattttggaggacacgctgatgcgcatcctggtcatcgggctgtcccgggagctcccgctcgggcctgcggacgccatggagcttgctgaccacctggtgaagcgggcggctgccgtgcaggcggatgatgtggaggtgctgaaggtggggaggacccagctgatcgacgccgttctgaatctgtgcacctaccatcaccctgaaaacatccagctcccaccggggtaccagcctccgaacctcgccatctctaccctctactggaaggcctggcccctcctgctggtcgtcgccgcattcaacccagagaacatcggcctggctgcgtgggaggagtacccgaccctgaagatgctcatggagatggtgatgaccaacaactactcctacccaccgtgcaccctgacggatgaggagacccggacggagatgctgaaccgtgagctgcagaccgcccagcgggagaagcaggagatcctggccttcgaggggcacctggcggccgcgtccaccaagcagaccatcactgagagcagcagcctcctcctgtcgcagctcaccagcctggacccccagtacgcagcccacacagccccgccctgcgcctgccgtcgggacctggggcccccccggaggcctccccctcacatcctggatcaagtgaaaagcctcaaccagtccctccgcctcgggcacctcttgtgccgcagccgaaaccctgactttctcctccacatcatccagcggcaggcctcctcgcagtccatgccctggctggcggacctggtacagtccagcgagggctccctggacgtgctgcccgtgcagtgtctgtgcgagttcctgctgcacgatgctgtggacgatgctgcttccggggaggaggacgacgagggcgagagcaaggagcagaaggccaagaagcggcagaggcaacagaagcagcggcagctgctgggccgcctgcaggacctgctactgggcccgaaggctgatgagcagaccacgtgtgaggtgctggactacttcttgcggcgcctcggctcctcccaggtggcctcccgcgtgctggccatgaagggtgagaccctgcctgcactgccgaaagccggcccagctcatgagtgtctgccacagggtttgtcgctggtgctttcggagggcagcctgcgggacggggaggagaaggagccccccatggaggaggatgtgggggacacagatgtgctgcagggctatcagtggctgctgcgggacctgcctcgcctgcctctgttcgacagcgtcaggagcaccacagccctggccctgcagcaggcaatccacatggagactgatccccagaccatcagcgcctacctgatctacttgtcccagcacacgcctgtggaggagcaggcccagcacagcgacctggccctggacgtggcccggctggtcgtggagcgctccaccatcatgtcccacctcttctcgaagctctccccgagtgccgcgtcggacgccgtgctgagcgctctgttgtccatcttctcacgctacgtgaggcgcatgcggcagagcaaggagggcgaggaggtctacagctggtcggagtctcaggaccaggtcttcctacgctggagcagcggggagacagccaccatgcacatcctcgtggtccatgccatggtgatcctgctgacgctgggcccgcctcgagccgacgacagcgagttccaggcgctgctggacatctggtttccggaggagaagccactgcccaccgccttcctggtggacacatcggaggaggcgctgctgcttcctgactggctgaagctgcgcatgatccgttctgaggtgctccgcctggtggacgccgccctgcaggacctggagccgcagcagctgctgctgttcgtgcagtcgtttggcatccccgtgtccagcatgagcaaactcctccagttcctggaccaggcagtggcccacgacccccagactctggagcagaacatcatggacaagagtaagatgccagggacctgcggagtgggttcacacacgctgaccgagccccagcccggccaggcttttggggcctgggtgcgagcgggtgtgaccctgctacggtttgcagattacatggcccacctggtggaggtccagcatgagcgcggcgcctccggaggccagactttccactccttgctcacagcctccctgccgccccgccgagacagcacagaggcacccaaaccaaagagcagcccagagcagcccataggccagggccggattcgggtggggacccagctccgggtgctgggccctgaggacgacctggctggcatgttcctccagattttcccgctcagcccggaccctcggtggcagagctccagtccccgccccgtggccctcgccctgcagcaggccctgggccaggagctggcccgcgtcgtccagggcagccccgaggtgccgggcatcacggtgcgtgtcctgcaggccctcgccaccctgctcagctccccacacggcggtgccctggtgatgtccatgcaccgtagccacttcctggcctgcccgctgctgcgccagctctgccagtaccagcgctgtgtgccacaggacaccggcttctcctcgctcttcctgaaggtgctcctgcagatgctgcagtggctggacagccctggcgtggagggcgggcccctgcgggcacagctcaggatgcttgccagccaggcctcagccgggcgcaggctcagtgatgtgcgaggggggctcctgcgcctggccgaggccctggccttccgtcaggacctggaggtggtcagctccaccgtccgtgccgtcatcgccaccctgaggtctggggagcagtgcagcgtggagccggacctgatcagcaaagtcctccaggggctgatcgaggtgaggtccccccacctggaggagctgctgactgcattcttctctgccactgcggatgctgcctccccgtttccagcctgtaagcccgttgtggtggtgagctccctgctgctgcaggaggaggagcccctggctggggggaagccgggtgcggacggtggcagcctggaggccgtgcggctggggccctcgtcaggcctcctagtggactggctggaaatgctggaccccgaggtggtcagcagctgccccgacctgcagctcaggctgctcttctcccggaggaagggcaaaggtcaggcccaggtgccctcgttccgtccctacctcctgaccctcttcacgcatcagtccagctggcccacactgcaccagtgcatccgagtcctgctgggcaagagccgggaacagaggttcgacccctctgcctctctggacttcctctgggcctgcatccatgttcctcgcatctggcaggggcgggaccagcgcaccccgcaggcaggtcttgggaggaagcggcgggaggagctggtgctgcgggtccagggcccggagctcatcagcctggtggagctgatcctggccgaggcggagacgcggagccaggacggggacacagccgcctgcagcctcatccaggcccggctgcccctgctgctcagctgctgctgtggggacgatgagagtgtcaggaaggtgacggagcacctgtcaggctgcatccagcagtggggagacagcgtgctgggcaggcgctgccgagaccttctcctgcagctctacctacagcggccggagctgcgggtgcccgtgcctgaggtcctactgcacagcgaaggggctgccagcagcagcgtctgcaagctggacggactcatccaccgcttcatcacgctccttgcggacaccagcgactcccgggcgttggagaaccgaggggcggatgccagcatggcctgccggaagctggcggtggcgcacccgctgctgctgctcaggcacctgcccatgatcgcggcgctcctgcacggccgcacccacctcaacttccaggagttccggcagcagaaccacctgagctgcttcctgcacgtgctgggcctgctggagctgctgcagccgcacgtgttccgcagcgagcaccagggggcgctgtgggactgccttctgtccttcatccgcctgctgctgaattacaggaagtcctcccgccatctggctgccttcatcaacaagtttgtgcagttcatccataagtacattacctacaatgccccagcagccatctccttcctgcagaagcacgccgacccgctccacgacctgtccttcgacaacagtgacctggtgatgctgaaatccctccttgcagggctcagcctgcccagcagggacgacaggaccgaccgaggcctggacgaagagggcgaggaggagagctcagccggctccttgcccctggtcagcgtctccctgttcacccctctgaccgcggccgagatggccccctacatgaaacggctttcccggggccaaacggtggaggatctgctggaggttctgagtgacatagacgagatgtcccggcggagacccgagatcctgagcttcttctcgaccaacctgcagcggctgatgagctcggccgaggagtgttgccgcaacctcgccttcagcctggccctgcgctccatgcagaacagccccagcattgcagccgctttcctgcccacgttcatgtactgcctgggcagccaggactttgaggtggtgcagacggccctccggaacctgcctgagtacgctctcctgtgccaagagcacgcggctgtgctgctccaccgggccttcctggtgggcatgtacggccagatggaccccagcgcgcagatctccgaggccctgaggatcctgcatatggaggccgtgatgtga

SEQ ID NO: 21 - DNA, 2474 bp, Homo sapiens
ctcagtccggctcagctggggctgggcgccgtgggtctggcggttccgtagcggtcccagcgtctgtcccgccggccgggcggtcgcggcacagccgcgggaaggtgtcggatggcggttccgccgcgcggcgggcgcgccgcccacatggcggccatcagggcgctgcaacagtggtgccggcagcagtgcgagggctaccgcgacgtgaatatctgcaacatgaccagccacctccccgcagccgcctctgcaagccccaagttgacgggtctggtcccccgacagccaggggccatgggtgtggattccaggacctcctgttccccacagaaggcccaggaggcaaacaaggccagaccgttggcctgggagcctgctgcgggcaactcgcctgccagggcttccgttccagctgcacccaaccctgcagccaccagcgccacgtccgtccacgtgaggagcccagccaggccctctgagagccgcctggcccccactcccacggaggggaaagtccgccctcgtgtgaccaatagctccccgatgggctggtcgtcagctgccccgtgcacagcagcggctgcctcccatcccgccgtgcccccgagtgccccagaccctcgcccggccacaccccagggcgggggagccccccgagtggcagctcctcaaaccacactcagttcaagctccacatctgcagccacggtggaccccccagcctggaccccgtccgcctccaggacccagcaggcccggaataagtttttccaaacatcagcagtgccccccggcaccagcctttctggcagaggtcccaccccgtcacttgttctatccaaggacagcagcaaggagcaggcgcggaacttcctcaagcaggccctctcagcgctggaagaggctggcgctccggcgcctggcaggccctccccagccactgccgctgttcccagttctcagcccaaaactgaagcaccacaagcaagtcccttagccaagccgttacagtcctcgtctccccgggtgcttggcctcccttcgaggatggaaccgccagccccgctgagcacgagcagtacctctcaggcatccgcgttgcccccggcaggcaggaggaacttggctgaatcctcaggggtcggcagggtgggtgctggctccaggccgaagccagaggccccgatggcaaagggtaaaagcaccaccttaacgcaggacatgagcaccagcctccaggaaggccaggaggacgggccggcaggatggagagcgaatctgaagcccgtggacaggaggagcccagctgagaggactctgaagcccaaggaaccacgggccctggcagagccgagggcgggggaggcccccaggaaggtctcaggcagctttgctgggagtgtccacatcaccctgacccccgtgaggcctgacaggaccccacgcccagccagcccaggacccagcctcccagccaggtccccctccccaccccgccgcaggagactggccgtccctgccagcctcgacgtttgtgacaactggcttcggccggagccccctggccaggaagcccgagtgcagagctggaaggaggaggagaagaaacctcaccttcagggcagaccagggagacccttgtccccggccaatgtccctgctctgcctggcgagacggtgacctccccagtcaggctgcaccccgactacctctccccggaggagatacagaggcagctgcaggacatcgagaggcggctggacgccctggagctccgcggcgtggagctggagaagcgactgcgggcggccgagggagatgacgctgaggatagcctcatggtggactggttctggctcattcacgagaagcagcttctgctgagacaggagtcagagctgatgtacaagtccaaggcccagcgtctggaggagcagcagctggacatcgagggcgagctgcgccggctcatggccaagcccgaggctctgaagtcactgcaggagcggcggcgggagcaggagctgctggagcagtacgtgagcaccgtgaacgaccgcagtgacatcgtggactcgctggacgaggaccggctccgggaacaagaggaggatcagatgctgcgggacatgattgagaagctgggcctccagaggaagaagtccaagttccgcttgtccaagatctggtcaccaaaaagcaaaagcagcccctcccagtagtagccagtagggccgtgggctcggcccggacctggcatccggatttggactcggggccatgggcttggcccggacccggaacccggacttgtactcggggccgtgggctcggcccggacccggcattcggacttggactcgggaagggcctcctgtccctacaaggggcatgtggacagcagggacctgcgctaccgtctgtggtctcaataaagaaaccgaccacatggaaaaaaaaaaaaaaaaaa

SEQ ID NO: 22 - DNA, 3097 bp, Homo sapiens
ccacgcgtccgggcgccgtgggtctggcggttccgtagcggtcccagcgtctgtcccgccggccgggcggtcgcggcacagccgcgggaaggtgtcggagggcggttccgccgcgcggcgggcgcgccgcccacatggcggccatcagggcgctgcaacagtggtgccggcagcagtgcgagggctaccgcgacgtgaatatctgcaacatgaccacgtcgttccgcgacggcctggctttctgcgccatcctgcaccgccaccggcccgacctcataaacttcagtgctctcaagaaggaaaatatttatgaaaacaataaactggccttccgcgtggccgaggagcacttgggcatcccagccttgctggatgccgaggacatggtggccttgaaggtgcctgaccggctgagcatcttgacctacgtgtcccagtattacaactacttccacggccgctcccccattgggggcatggcaggcgtgaagagggcctcggaggactctgaggaggagccgtcagggaagaaggctccagtccaggcggccaagctgccctcgcccgccccagcccggaagcctccactatctccagcccagacaaaccctgtggtccagaggaggaatgagggtgcagggggcccgccccccaagactgaccaggcattggcgggcagcttggtcagcagcacctgcggggtctgcggcaagcacgtgcacctggtacagcggcacctggccgacgggaggctttaccaccggagctgcttcaggtgtaagcagtgctcctgcacgctgcactcgggggcctacaaggccacaggagagccgggcaccttcgtctgcaccagccacctccccgcagccgcctctgcaagccccaagttgacgggtctggtcccccgacagccaggggccatgggtgtggattccaggacctcctgttccccacagaaggcccaggaggcaaacaaggccagaccgtcggcctgggagcctgctgcgggcaactcgcctgccagggcttccgttccagctgcacccaaccctgcagccaccagcgccacgtccgtccacgtgaggagcccagccaggccctctgagagccgcctggcccccactcccacggaggggaaagtccgccctcgtgtgaccaatagctccccgatgggctggtcgtcagctgccccgtgcacagcagcggctgcctcccatcccgccgtgcccccgagtgccccagaccctcgcccggccacaccccagggcgggggagccccccgagtggcagctcctcaaaccacactcagttcaagctccacatctgcagccacggtggaccccccagcctggaccccgtccgcctccaggacccagcaggcccggaataagtttttccaaacatcagcagtgccccccggcaccagcctttctggcagaggtcccaccccgtcacttgttctatccaaggacagcagcaaggagcaggcgcggaacttcctcaagcaggccctctcagcgctggaagaggctggcgctccggcgcctggcaggccctccccagccactgccgctgttcccagttctcagcccaaaactgaagcaccacaagcaagtcccttagccaagccgttacagtcctcgtctccccgggtgcttggcctcccttcgaggatggaaccgccagccccgctgagcacgagcagtacctctcaggcatccgcgttgcccccggcaggcaggaggaacttggctgaatcctcaggggtcggcagggtgggtgctggctccaggccgaagccagaggccccgatggcaaagggtaaaagcaccaccttaacgcaggacatgagcaccagcctccaggaaggccaggaggacgggccggcaggatggagagcgaatctgaagcccgtggacaggagaagcccagctgagaggactctgaagcccaaggaaccacgggccctggcagagccgagggcgggggaggcccccaggaaggtctcaggcagctttgctgggagtgtccacatcaccctgacccccgtgaggcctgacaggaccccacgcccagccagcccaggacccagcctcccagccaggtccccctccccaccccgccgcaggagactggccgtccctgccagcctcgacgtttgtgacaactggcttcggccggagccccctggccaggaagcccgagtgcagagctggaaggaggaggagaagaaacctcaccttcagggcaaaccagggagacccttgtccccggccaatgtccctgctctgcctggcgagacggtgacctccccagtcaggctgcaccccgactacctctccccggaggagatacagaggcagctgcaggacatcgagaggcggctggacgccctggagctccgcggcgtggagctggagaagcgactgcgggcggccgagggagatgacgctgaggatagcctcatggtggactggttctggctcattcacgagaagcagcttctgctgagacaggagtcagagctgatgtacaagtccaaggcccagcgtctggaggagcagcagctggacatcgagggcgagctgcgccggctcatggccaagcccgaggctctgaagtcactgcaggagcggcggcgggagcaggagctgctggagcagtacgtgagcaccgtgaacgaccgcagtgacatcgtggactcgctggacgaggaccggctccgggaacaagaggaggatcagatgctgcgggacatgattgagaagctgggcctccagaggaagaagtccaagttccgcttgtccaagatctggtcaccaaaaagcaaaagcagcccctcccagtagtagccagtagggccgtgggctcggcccggacctggcatccggacttggactcggggccatgggcttggcccggacccggaacccggacttgtactcggggccgtgggctcggcccggacccggcattcggacttggactcgggaagggcctcctgtccctacaaggggcatgtggacagcagggacctgcgctaccgtctgtggtctcaataaagaaaccgaccacatggaaaaaaaaaaaaaaaaaa

SEQ ID NO: 23 - DNA, 1041 bp, Homo sapiens
  misc_feature 903: n = A,T,C or G
cgcggtggcggcgggcggcgcgggggcacttgttgttcttcgcgaagtcggagcccgagcgccaggcggcggcggcggccgaggggagcgcgacagtgagcgccggcgcgaggacagcgcgtgcccgcgaggagccgccgcgcgcccgcgccctccgcgcgacgccagctacgagttccagggagctctgtcctggtgaccgtgcccgggttatgacgactaatcccaaaccgaataaggcattaaaggtcaagaaggaggcgggcgagaacgccccggtgctcagcgatgatgagctggtgtccatgtcggtgcgggagctgaaccagcacctgcggggtctcaccaaggaggaggtgacccgcctgaagcagcgtcggcgcacactcaagaaccgcggctacgcggccagctgccgcatcaagcgggtgacgcagaaggaggagctggagcggcagcgcgtggagctgcagcaggaggtggagaagctggcgcgtgagaacagcagcatgcggctggagctggacgccctgcgctccaagtacgaggcgctgcagaccttcgcgcgcaccgtggcccggggacctgtggcgccctccaaggtggccaccaccagcgtcatcaccatcgtcaagtccaccgagctctcctccacctccgtgcccttctcggctgcatcctagtgccggccgggggcggggggtggcgggcggcgggcggcgggcaggcgggtgggggcacacccctcgtacctgtcactgggatgcagactctcgacatccgagtccaagcgcaggcccctcgggcgcaggcagctcacaccaggaagagactgtattgcagggtgaagagtgggctcccgtgggcccagagctgcacgccggtccacagacacactcacgnccgccacctgctccccgcagatgtgtctgtgtgtgggaattggtatcttgcacccgtgggagtcgggacatataatggaaaggccctcgggaagttccgcgtcctctgtgggggctgccggaagacacggcccccagg

SEQ ID NO: 24 - DNA, 2608 bp, Homo sapiens
agctcgccggcctttggtctccaggacttgtcccagcagcccctcgaactgagaattacaccatcggacccctggctctgaggccttcagacttggactgtgtcacactgccaggcttccagggctccaacttgcagacggcctgttgtgggacagtctctgtaatcgcgaaagcaaccatggaagacctgggggaaaacaccatggttttatccaccctgagatctttgaacaacttcatctctcagcgtgtggagggaggctctggactggatatttctacctcggccccaggttctctgcagatgcagtaccagcagagcatgcagctggaggaaagagcagagcagatccgttcgaagtcccacctcatccaggtggagcgggagaaaatgcagatggagctgagtcacaagagggctcgagtggagctggagagagcagccagcaccagtgccaggaactacgagcgtgaggtcgaccgcaaccaggagctcctgacgcgcatccggcagcttcaggagcgggaggccggggcggaggagaagatgcaggagcagctggagcgcaacaggcagtgtcagcagaacttggatgctgccagcaagaggctgcgtgagaaagaggacagtctggcccaggctggcgagaccatcaacgcactgaaggggaggatctcggaactgcagtggagcgtgatggaccaggagatgcgggtgaagcgcctggagtcggagaagcaggacgtgcaggagcagctggacctgcaacacaaaaaatgccaggaagccaatcagaaaatccaggaactccaggccagccaagaagcaagagcagaccacgagcagcagattaaggatctggagcagaagctgtccctgcaagagcaggatgcagcgattgtgaagaacatgaagtctgagctggtacggctccctaggctggaacgggagctggagcagctgcgggaggagagcgcactgcgggagatgagagagaccaacgggctgctccaggaagagctggaagggctgcagaggaagctggggcgccaggagaagatgcaggagacgctggttggcttggagctggagaacgagaggctgctggccaagctgcaaagctgggagagactggaccagaccatgggcctgagcatcaggactccagaagacctttccagattcgtggttgagctgcagcagagggagcttgccttgaaggacaagaacagcgccgtcaccagcagcgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctcccctaaaa

SEQ ID NO: 25 - DNA, 2742 bp, Homo sapiens
gtcactcgtataaaaacctatgctttgaaggttctcgtgtgtctcggcctgcaggtctcgctcagagctgtgtccctgaacatccaccctgctggggtggcttgacgcacttctgtgcaaatctgttcgctcgcaaccctacctacctctctcccgaaccggagaaaaccttcggcggggtccttccgggttttgtgtcgaatctgcggcggcgacccggcgccgcgtcacgcggtggtgaatgtgcggcagtacgcgcgccgcgtcgtttacgcggcgatttcatcatgctccgagccggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctcctccgccggtccctcagcgcggcctcctgcgccccgatctccttgcccgccgccgcctcccggagcagcatggacggcgcgggggctgaggaggtgctggcacctctgaggctagcagtgcgccagcagggagatcttgtgcgaaaactcaaagaagataaagcaccccaagtagacgtagacaaagcagtggctgagctcaaagcccgcaagagggttctggaagcaaaggagctggcgttacagcccaaagatgatattgtagaccgagcaaaaatggaagataccctgaagaggaggtttttctatgatcaagcttttgctatttatggaggtgttagtggtctgtatgactttgggccagttggctgtgctttgaagaacaatattattcagacctggaggcagcactttatccaagaggaacagatcctggagatcgattgcaccatgctcacccctgagccagttttaaagacctctggccatgtagacaaatttgctgacttcatggtgaaagacgtaaaaaatggagaatgttttcgtgctgaccatctattaaaagctcatttacagaaattgatgtctgataagaagtgttctgtcgaaaagaaatcagaaatggaaagtgttttggcccagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacggttggattgagattgttggatgtgctgatcgttcctgttatgacctctcctgtcatgcacgagccaccaaagtcccacttgtagctgagaaacctctgaaagaacccaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaaggggaattcacaattgaaactgaagggaaaacatttcagttaacaaaagacatgatcaatgtgaagagattccagaaaacactatatgtggaagaagttgttccgaatgtaattgaaccttccttcggcctgggtaggatcatgtatacggtatttgaacatacattccatgtacgagaaggagatgaacagagaacattcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaactactcttatgtccactttacaaaagaaaacagcattgtgattactcccagggaccgtattttatcttcagtggctgcctgattttacccccacaattaaagttgaaggaatcctga

SEQ ID NO: 26 - DNA, 2742 bp, Homo sapiens; identical to SEQ ID NO: 25

SEQ ID NO: 27 - DNA, 1048 bp, Homo sapiens
acagctgtgaagtgtgaggttctttgtctgctggcagctaggggcgacgaggcgggacgtcatggaagtgaaggatgccaattctgcgcttctcagtaactacgaggtatttcagttactaactgatctgaaagagcagcgtaaagaaagtggaaagaataaacacagctctgggcaacagaacttgaacactatcacctatgaaacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagcatagaagagcacagctggccccggcgtttcatgaagtcagaaggcctggcagccatttcctggacgttgagaggattgtttatttgatttttatcctcatcccagcaggcctggctttgtggttagttgggtacatcacaaaaataagttaaaaagaaatatttgtgccttggggagaagaaacatggtgaaaacaggctgaggttgtcagggcagagagctgaaggtggggacagtgaccgcggacccctctgtgcttgaaagatttcctccacggcctttgccccagttgtggggaggtctctgtgcacagcggggaaaatgcttgtgtcgcctttggtgggccatgtcctaattagtttcatctgcttccctgggaacttactaaggggcccagagcactgttggaagtctggttagagtccccagagagttactctaagttaaaatgagccactgaccttggctcaccttagaggaatttcctcgagaacaacagagataagaaaagaaccggcctggccaatccttcaacagctctaga

SEQ ID NO: 28 - DNA, 2576 bp, Homo sapiens
agcccgcagccggccgcgtcatgccaggcgctgctcggcggtagggagtgcccggggccgccgcctccgcccgcccgaagccgcgcccactgcccagagccagagggatggtggtagtcacggggcgggagccagacagccgtcgtcaggacggtgccatgtccagctctgacgccgaagacgactttctggagccggccacgccgacggccacgcaggcggggcacgcgctgcccctgctgccacaggagtttcctgaggttgttccccttaacatcggaggggctcacttcactacacgcctgtccacactgcggtgctacgaagacaccatgttggcagccatgttcagtgggcggcactacatccccacggactccgagggccggtacttcatcgaccgagatggcacacactttggagatgtgctgaatttcctgcgctcaggggacctcccacccagggagcgtgttcgagctgtgtacaaagaggcccagtactatgccatcgggcccctcctggagcagctggagaacatgcagccactgaagggcgagaaggtgcgccaagcgtttctgggactcatgccctattacaaagaccacttggagcggattgtggagatcgcccggctgcgtgcggtccagcggaaggcccgctttgccaagctcaaggtctgtgtcttcaaggaggagatgcccatcaccccctatgagtgtccgctcctcaactccctgcgatttgagcggagtgagagtgacgggcagctttttgagcaccactgtgaagtggatgtgtcttttgggccctgggaggctgtggctgatgtttatgacctgctgcactgcctggtcacggacctctcggcccagggtctcaccgtggaccaccagtgcatcggggtgtgtgacaagcacctcgtgaaccactactactgcaagcgccccatctatgagttcaagatcacatggtggtgagtagccccggtaggcgagagtcccatcagggaggatgtccaccttgcttggtggctctgggagtaagatccctgaaggggctgctgactgccccagaatctgccgaggtgagaacagcatcctgaggcacagctcccaggggacagaggtgtagctccaatctccctgactgcacctcagggttgggctcagggcttgcggcctgcaggcactccagccagcgctcacctggcctttcctcaaggcatggtagtctttccttgaggctgatagctagggcttgaccaggaagtcccgagaagttttgtcaccttcttgaccttgcaagagagtttctgcccattttagggccacgttaccaaatcgatgtaggcctaatcacttcctcaaccctgttcaagcgtccctcccttgtgctcagtatattggtgtgaacacggaacatgatgggggatttacctgaccagccaccccatagcccctggctgaagaagaaagagcatcttctctcccactgcaccccttctcctccaagaatagttgcccacattcccaaaatgtggaaagacttttcttttccttccggaacatgttcttcaccaccttttggagatttaaccatagctgccaaagctatgcacccagttggccttagaaaaccacaatgtttacagccctgtcttagggccgcggcttctcttatcttccaccaccttccttgcttgcagggttatcttctcacagggctggaatgcaaatttcagaggcttcttttgaagattccccaagtcaagcaggcaagatgcctagatcttctgttatctttgacatgtaacatcctttttagaggctcagaacacctccttggctgctatctcatgtgttagaatccagtttgtggtgaacctctttggaaggggaccccctctctttaaaccctgttcctctgtcctggtaacattctccttctaggagagcctctcttctgagaaggtaaaggaagggctgggtgagacacacagctatcctaggagccgtaggaagacaaaacttcccttttgttttactcctcactcctctatttttgttttactcacttctttatattttgttttactcctcactcctgtatattttggtttacttactcctctatttcagaaattgaaaaagatccccaaggatctgttactactgcatttccttcttgctctgtctacagcctaggccaactagtcagggtctggacatgcatctcctaaaggaagaactgtgtagcaccattgatcacaatgtaacatttccatgctgcattaagggtgtctctctctaatcatgattgtacctgtctcttcctgggtaaagggagattttttttttttaatgtgcaaagaattgatgcgagccaggaacatgtctgtagtcccagctacttgggcacacgcctgtagtccaggccactcgagcacacacctgtagtaccagctactctggaggctgaggcaggaggatcacttgagcccaggagattaagactgtagtatactatgatcgtgcctgtggctagccactgtgctccagcctgggcaacaccatcgt

SEQ ID NO: 29 - DNA, 3740 bp, Homo sapiens
agacctacccgggcgaagcgggcgagcggtggtttggacgccggcggagacgcgggcgagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaaggaaattcaggaagcaaaagctcccagtccttccataaaccggcaaaccagcattgaaacggatagagtgtctaaggagttcatagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaagattcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccacaaaagctgacttttttgggtctcttacatataaagtaggtcattgagttgatttttttggaggtatctcatattggtcgaattcttctggtatggactcttgccttatatagaggcttctatttctcttaagtcaccatcaatacaacggccggagtttctgtttttgcaataagaagatgttggtattttatgtagggtaaatgtgactggaatacacctttggaacggaattctttatcaataaagtttcacaatccgtccctcttccaaaaaaaaaa

SEQ ID NO: 30 - DNA, 1929 bp, Homo sapiens
agcccgaactgaggcggcggcgggagcccggttggcgtctggtcttcgcgtcggccccgcggagccagacgctgcccccggcgcggggagaagatggtgccgagcggcctcgggcccgccacgcgccgccacgagtgagcccagcgcgaccgcgggcgtccgccgagcagctggcccggctgggcccggggcgcgcagctgcccgccggggcggggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggcagggaagcccacgaggagataaacatcaccttcaccctgcctacagcgtggagctcagatgactgcgccctccacggtcactgtgagcaggtggtattcacagcctgcatgaccctcacggccagccctggggtgttccccgtcactgtacagccaccgcactgtgttcctgacacgtacagcaacgccacgctctggtacaagatcttcacaactgccagagatgccaacacaaaatacgcccaagattacaatcctttctggtgttataagggggccattggaaaagtctatcatgctttaaatcccaagcttacagtgattgttccagatgatgaccgttcattaataaatttgcatctcatgcacaccagttacttcctctttgtgatggtgataacaatgttttgctatgctgttatcaagggcagacctagcaaattgcgtcagagcaatcctgaattttgtcccgagaaggtggctttggctgaagcctaattccacagctccttgttttttgagagagactgagagaaccataatccttgcctgctgaacccagcctgggcctggatgctctgtgaatacattatcttgcgatgttgggttattccagccaaagacatttcaagtgcctgtaactgatttgtacatatttataaaaatctattcagaaattggtccaataatgcacgtgctttgccctgggtacagccagagcccttcaaccccaccttggacttgaggacctacctgatgggacgtttccacgtgtctctagagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtctgtggcttaataatcatagtaacaacaataatacctttttctccattttgcttgcaggaaacataccttaagttttttttgttttgtttttgtttttttgttttttgttttcctttatgaagaaaaaataaaatagtcacattttaatactaaaaaaaaaaaaaaaaaaaaaaaaaaaaaacccacgcgtccgcccacgcgtccgcggacgcgtgggcggacgcacgcgtccgaaaaaaaaaaaaaaaaaaaaaaaaaaaaaaaaaaaaaaa

SEQ ID NO: 31 - DNA, 1513 bp, Homo sapiens
atccggcgcggtgtttagactccactgatgtcgtggcgctttaggggaagaagttggtgtttcgctgggccctggtactgaagacgcggtccgggtcgcccctagctgtttcctactcacccaaagccccgcacccgccttttctctctctcctctggcaggatgaggcgtgcaggcctgggtgaaggagtacctcctggcaactatgggaactatggctatgctaatagtgggtatagtgcctgtgaagaagaaaatgagaggctcactgaaagtctgagaagcaaagtaactgctataaaatctctttccattgaaataggccatgaagttaaaacccagaataaattattagctgaaatggattcacaatttgattccacaactggatttctaggtaaaactatgggcaaactgaagattttatccagagggagccaaacaaagctgctgtgctatatgatgctgttttctttatttgtcttttttatcatttattggattattaaactgaggtgatgcatgtaattgtgaatttggaatttgttccaacttaatggcttgcagtaccactttgataaaaatcagcatcaaaacattcctagtgttcaaatactgtggcattttccattgaaaattgctgaattttgcttattttataaatcacattagttaatacagtggtctttgaatactgtttcttaatgactcattttagcccctattttcaggggtagtgagagggtgtggctccactaatttccagtttgtttttctattgtttgccaactgtcagattaaatagcattataatattttgttgtaatcataaatgcaggtttatgtcccatgtaaggaaacttagtgggagagtaacagaatgcctggagagcctgactctgagctcttgaagtagtcagccagtttgtggtaaaatggtaattgaattttcctaactgcatcaactgtaatgatatactcccttctcctcctttatttagttaaaattgtaggctgatttctttttacctacaatcttcctaataatttttgatgataatgacccctcatttctttctgcccaaagacctcattctttaaataaaacttgttattttggcatatttctggtagggcccattgcacatgtgtatcagtatagttattatttcatattaactttatgaattctcttgacttggcttataatagttttatgatttttactacataggtagcacatttatcatttgtgacagaataatgtgaagttaagtaattactgaactttaaatggaaatagtatgcaagaaactcaggcattgaacttgaagataagagtattattgctttaatccagtgtatttgtttatggaaagaaaaacacaaaggcagactgttgagtaaaaaatattaaatattgttaaatattctgtattttggaatttatccatttataggcttcaaaagtaaatttttaaataaaatatattagtcgaaaaaaaaaaaaaaa

SEQ ID NO: 32 - DNA, 3883 bp, Homo sapiens
gaggccgccgagtcggccgcggccgaggaggggcaggcggaggtcgggggcgccgcggccgcggggtcaggttccccggcgggaggcgcaggtggcggcctggggagctggcggccgctcctcgcctggctgcagcggcggcagccccagtgctgcccctgtgcggcgcccctttcccgctccgccgcgcactgttgtcatggaggaaccagatggcggctctggcctacaacctgggcaagcgggagatcaaccactacttcagcgtgaggagcgccaaggtgctggcgctggtggccgtgctgctgctcgcagcgtgccacctcgcctcccgccgctaccgaggcaatgattcgtgtgaataccttctctcaagtggcagatttcttggagagaaagtttggcaacctcacagttgtatgatgcataaatacaaaatcagtgaagcaaagaactgccttgtagataaacatattgcatttattggagattccagaattcgtcaattgttttattcttttgtaaaaataattaatccccaattcaaagaagaaggaaataagcatgaaaacattccttttgaagacaagactgcatcagttaaagtggattttctgtggcatcctgaagttaatggttctatgaaacagtgtatcaaagtgtggactgaggattccattgcaaagccacatgtgattgtagcaggagctgccacatggtccatcaagattcacaatggtagcagtgaagcgctttctcaatataaaatgaacatcacctccatagcaccacttttagaaaaattggcaaagactagtgatgtttattgggtcttacaagatcctgtttatgaagatctattaagtgaaaataggaagatgatcactaatgagaagatagatgcttacaatgaagctgcagtcagtattttgaatagtagcaccagaaattctaaatcaaatgttaagatgttcagtgtttccaaattaattgctcaagaaaccatcatggaatctttggatggcttacatcttcctgaatcgagcagagaaactactgcaatgattcttatgaatgtgtattgcaataagattttgaagcctgtagatgggtcctgttgtcaacctcggcctcctgttactctcatacagaagctagctgcttgttttttcactttatctattatcggatatttaattttttacataattcatcgtaatgctcatcggaagaataagccgtgtactgatttggaaagtggagaggaaaagaaaaatattatcaatacccctgtgtcttcattagaaatacttttacaatctttctgcaaacttggcctgattatggcatatttctatatgtgtgacagtgcaaatctgttcatgaaggaaaacaaattttatacacattcatctttctttattccaattatctacattttggttttgggagtattttataatgaaaatactaaagagactaaagtattaaatagagaacaaacagacgaatggaaaggctggatgcaacttgtgattttgatttatcacatttctggagcaagtacatttttgcctgtatacatgcacattcgagttctggttgctgcatatttatttcagacagggtatgggcatttctcatacttttggataaaaggagattttggaatctacagagtatgtcaggttttatttcgtctcaatttcctggtagtggtgttatgtatagtaatggatcgaccttatcaattctattactttgtccccttggtcactgtatggttcatggtcatatatgttactttagcactatggccacaaataatccaaaaaaaagcaaacggaaattgtttctggcattttggcttactgttgaaactaggctttttgctgttattcatatgttttttggcatattctcagggtgcatttgagaagatcttttctctttggccattgtccaagtgttttgaactgaaagggaatgtatatgaatggtggttcagatggaggttagaccgttatgtagttttccacggaatgctgtttgcttttatttatctggccttgcagaagcgtcaaatactttctgaaggaaagggtgaacctcttttttcaaacaaaatttcaaattttctgttgtttatttcagtagtttctttcttgacctattccatctgggctagcagttgtaaaaacaaagcagagtgcaatgaactccatccgtctgtttctgtggtacagattttagccttcatcctaataagaaacatccctggatatgcccgttcagtttacagttcattttttgcttggtttggaaaaatttcattagagctatttatttgccagtatcacatatggctggcagcggacacaaggggtatcttggtactgatacctggaaaccctatgctcaacatcattgtcagcactttcatatttgtttgtgtggcacatgaaatttctcagatcactaatgatcttgcacagattattattcctaaagataactcatctctcttgaaaaggttggcatgtatagctgcatttttttgtggactcctcatcttatcatccattcaagataaatcaaaacattaggttccaaaaattctaaaaaacctaaactcttcaggctacctttgtgtgtctctagaagagaaaagcatctatctggagatataaatgtgtatgtaaatataaacgtttgtggcaagaggacagttctgtgacatctgttgaacatatgtggttgtatatattggaaatgtacatatccaatatgaaatactaaaacaaacaaacaaacaaaaaaccagaatgcattgtataggattgcatgtgaagtcttttctactgaatctatatttccatttgtaagtgattttaagttaacatatgaaggcagggaaatgattacctttccagtaaaaagtatagataatttaattaacttagtgacaccaccaagtgttttgatataactaaatttgtggtaataagactgtctgcacctgtattcattgtggaacttcctctttcattggaaactttcttactcaagaatgacggcagtattgttttcttatatgtgcaatgaagtggaatgataaacagtatgcctttaatttatatgtgttcttgttctgatgttgtttcctgaaatgatttttcttcctaactgtggttttcgggtatgcaagcctaaatctttgtacactttgtctcacagaatagttctgaggctccatgacagggttttgtcattgttgatgttattgttgcttcgttttataaaaaagccaaaatttttttttccaatccaaacgttcacctgtttcctttcctcaagctataccagtgtaataccagttaccctgtggatccatttaatatgttatccccactaattaattttcgtatattatttccaatatttggaaagctctttatagccatttggtatttcctattacccacctcctattttaaatatttatcagtctaaacttgtgcagtgtagtaaacatgcaagttgttatgattgagctgtattaccataagtagaattttaagtaaactggtgaatttgggccatagatgtttttgctttttgtttgatttttttttacaagctaactgttagaggtatacatttatttatctgttgtacagatttgattatgattttaatgtttgaaagattgcacttgtttgcttttactatatgtggggtaaaatatattttctgttcacagtatatgaaaatatggagtaatttaaacagtaaataaacattctgtggatgcttaaaaaaaaaaaaaaaaaaaaaaaaaaaaaaaaaaaaaaaaaaaaaaaaagaaaaaaaaaaaaaaaaa

SEQ ID NO: 33 - DNA, 1891 bp, Homo sapiens
ccgcttcggggaggaggacgctgaggaggcgccgagccgcgcagcgctgcgggggaggcgcccgcgccgacgcggggcccatggccaggaccaccagccagctgtatgacgccgtgcccatccagtccagcgtggtgttatgttcctgcccatccccatcaatggtgaggacccagactgagtccagcacgccccctggcattcctggtggcagcaggcagggccccgccatggacggcactgcagccgagcctcggcccggcgccggctccctgcagcatgcccagcctccgccgcagcctcggaagaagcggcctgaggacttcaagtttgggaaaatccttggggaaggctctttttccacggttgtcctggctcgagaactggcaacctccagagaatatgcgattaaaattctggagaagcgacatatcataaaagagaacaaggtcccctatgtaaccagagagcgggatgtcatgtcgcgcctggatcaccccttctttgttaagctttacttcacatttcaggacgacgagaagctgtatttcggccttagttatgccaaaaatggagaactacttaaatatattcgcaaaatcggttcattcgatgagacctgtacccgattttacacggctgagatcgtgtctgctttagagtacttgcacggcaagggcatcattcacagggaccttaaaccggaaaacattttgttaaatgaagatatgcacatccagatcacagattttggaacagcaaaagtcttatccccagagagcaaacaagccagggccaactcattcgtgggaacagcgcagtacgtttctccagagctgctcacggagaagtccgcctgtaagagttcagacctttgggctcttggatgcataatataccagcttgtggcaggactcccaccattccgagctggaaacgagtatcttatatttcagaagatcattaagttggaatatgactttccagaaaaattcttccctaaggcaagagacctcgtggagaaacttttggttttagatgccacaaagcggttaggctgtgaggaaatggaaggatacggacctcttaaagcacacccgttcttcgagtccgtcacgtgggagaacctgcaccagcagacgcctccgaagctcaccgcttacctgccggctatgtcggaagacgacgaggactgctatggcaattatgacaatctcctgagccagtttggctgcatgcaggtgtcttcgtcctcctcctcacactccctgtcagcctccgacacgggcctgccccagaggtcaggcagcaacatagagcagtacattcacgatctggactcgaactcctttgaactggacttacagttttccgaagatgagaagaggttgttgttggagaagcaggctggcggaaacccttggcaccagtttgtagaaaataatttaatactaaagatgggcccagtggataagcggaagggtttatttgcaagacgacgacagctgttgctcacagaaggaccacatttatattatgtggatcctgtcaacaaagttctgaaaggtgaaattccttggtcacaagaacttcgaccagaggccaagaattttaaaactttctttgtccacacgcctaacaggacgtattatctgatggaccccagcgggaacgcacacaagtggtgcaggaagatccaggaggtttggaggcagcgataccagagccacccggacgccgctgtgcagtgacgtggcctgcggccgggctgcccttcgctgccaggacacctgccccagcgcggcttggccgccatccgggacgcttccagaccacctgccagccatcacaaggggaacgcagaggcggaaaccttgcagcatttttattt

SEQ ID NO: 34 - DNA, 1600 bp, Homo sapiens
cggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtagtctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatcccaaaaaaaaaaaaaaaaaaaaaaaaaaaaaaaa

SEQ ID NO: 35 - DNA, 3634 bp, Homo sapiens
actgcatctccgactctctgcccagactcttcactccgcggcaccctcaaaccccagcccaggccggggcgcacgagccagccagcgcacctgcagtcctcgcccggacgcgccgcgccccctcggaaccaggctctgctccgagcagccttcgcccctcaagccagccacagtccccgccaggccgggtgggcgtcaagatgaaggcggcccgcttcgtgctgcgcagcgctggctcgctcaacggcgccggcctggtgccccgagaggtggagcatttctcgcgctacagcccgtccccgctgtccatgaagcagctactggactttggttcagaaaatgcatgtgaaagaacttcttttgcatttttgcgacaagaattgcctgtgagactcgccaacattctgaaggaaattgatatcctcccgacccaattagtaaatacctcttcagtgcaattggttaaaagctggtatatacagagcctgatggatttggtggaattccatgagaaaagcccagatgaccagaaagcattatcagactttgtagatacactcatcaaagttcgaaatagacaccataatgtagtccctacaatggcacaaggaatcatagagtataaagatgcctgtacagttgacccagtcaccaatcaaaatcttcaatatttcttggatcgattttacatgaaccgtatttctactcggatgctgatgaaccagcacattcttatatttagtgactcacagacaggaaacccaagccacattggaagcattgatcctaactgtgatgtggtagcagtggtccaagatgcctttgagtgttcaaggatgctctgtgatcagtattatttatcatctccagaattaaagcttacacaagtgaatggaaaatttccagaccaaccaattcacatcgtgtatgttccttctcacctccatcatatgctctttgaactatttaagaatgcaatgcgggcaacagttgaacaccaggaaaatcagccttcccttacaccaatagaggttattgttgtcttgggaaaagaagaccttaccattaagatttcagacagaggaggtggtgttcccctgagaattattgaccgcctctttagttatacatactccactgcaccaacgcctgtgatggataattcccggaatgctcctttggctggttttggttacggcttgccaatttctcgtctgtatgccaagtactttcaaggagatctgaatctctactctttatcaggatatggaacagatgctatcatctacttaaaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctgcaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgatacgaataagaaagggagtgagtgtgaagatggtggttagcagtttcactagactgatattttaggcctcttgttcacatcaaaagatattggtgtcagaataccagcattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagctaatgaatgacacctgaaatgcatatggtatttttgggagagttaaggtataatttgaagattggcagaccagtcgcgctgattactcttagagaagaagaaatggaaaaatgaaagaaggcaggaaggaaagaaaggatgcaggaaggaaagaaaggatacaggaagagagggaagcagaaggcagtcatttttctattttccccacaaattatttcaaaaaaaatctgtattttctgggatatgtcattggcaagaggaagaactggtgtttcgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgttgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgatcatacaaaacagtttgcagtaggttatctgtcatttcagttttttactgaaatttgagctaaacatttttacatgtaatacttgtatttaccaaagatttaaatcagttgattaattaattaactcaaatactgtgaactatctttaaaacactagaaaaaagaaatgttagtatctcaattacaccaactgtgcaaatgaactttgataaaatagaaataatctacattggcctttgtgaaatctggggaagagctttaggattttagtagatggatactgaatactcaggcccccttaaattattaatgtatacattgtgtttttgtctttatgctatgtacagagaaatgtgataattttttataataaatattttttatgatgataaaaaaaaaaaaaaaaaaaaaaaaaaaaaaaaaaaaaaaaaa

SEQ ID NO: 36 - DNA, 3150 bp, Homo sapiens
ggccaggaacgcacgctgcctggccgtatcgccgcccccaccgacgccgccgccgggactagaagtgagccgcccgggtcccaaacgccagccagccagtcagtgggtcccgcagtcgcccgcaaccggggcgaatcatggcggccgccaaggtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggattaatatcttttcaagaatttgttgcctttgaatctgtcctgtgtgcccctgatgctttgtttatggtagcctttcagctgtttgacaaagctggcaaaggagaagtaacttttgaggatgttaagcaagtttttggacagaccacaattcatcaacatattccatttaactgggattcagaatttgtgcaactacattttggaaaagaaagaaaaagacacctgacatatgcggaatttactcagtttttattggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgctgctggaggtaccacatcccatcaagttagtttctcctattttaatggatttaattcgctccttaacaacatggaactcattagaaagatctatagcactctggctggcaccaggaaagatgttgaagtgactaaggaggagtttgttctggcagctcagaaatttggtcaggttacacccatggaagttgacatcttgtttcagttagcagatttatatgagccaaggggacgtatgaccttagcagacattgaacggattgctcctctggaagagggaactctgccctttaacttggctgaggcccagaggcagaaggcctcaggtgattcagctcgaccagttcttctacaagttgcagagtcggcctacaggtttggtctgggttctgttgctggagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggtctgttgccacagttattgggagttgccccagagaaggccataaaacttacagtgaacgattttgtgagggataaatttatgcacaaagatggttcggtcccacttgcagcagaaattcttgctggaggctgcgctggaggctcccaggtgattttcacaaatcctttagaaatcgtcaagatccgtttgcaagtggcaggagaaatcaccactggtcctcgagtcagtgctctgtctgtcgtgcgggacctggggttttttgggatctacaagggtgccaaagcatgctttctgcgggacattcctttctcggccatctactttccgtgctatgctcatgtgaaggcttcctttgcaaatgaagatgggcaggttagcccaggaagcctgctcttagctggtgccatagctggtatgcctgcagcatctttagtgacccctgctgatgttatcaagacgagattacaggtggctgcccgggctggccaaaccacttacagcggagtgatagactgctttagaaagatactgcgtgaagaaggaccaaaagctctgtggaagggagctggtgctcgtgtatttcgatcctcaccccagtttggtgtaactttgctgacttacgaattgctacagcgatggttctacattgattttggaggagtaaaacccatgggatcagagccagttcctaaatccaggatcaacctgcctgccccgaatcctgatcacgttgggggctacaaactggcagttgctacatttgcagggattgaaaacaaatttggactttacctacctctcttcaagccatcagtatctacctcaaaggctattggtggaggcccataggaagatcagccctgggatagtgctgtctttttgtgggtactgcagtaaagaacatccctcctgggaatgaagcaatgcttcatcccttttacgtccatctcttgtttaaattcaagtccaggcttttttatcatgtgaaatcattcattttctgggtgttttcttaaccagatcattgtgaaattattcataattattatttggccctctgcccagaaacctttgtttgcatctgaaaattgatgggatttggtcaacactaacatgatttggggaaaggagcaagtcagaatagaaattagtactcccctccttgaactaggattgtagtcccaaagaggctactgtaaggcaatcatggtgctcagagcagtgtttcgtgtgtgttttaaactggtaggaaactaggtgcatatttataaaaataaaaaacactgggagaaatgaaaaaatatatatcaaatatattcagcctggcttcaaattgtaagcatgcacaaattctgtctctggattatattatgaagcttttatgtgaaacatgtttctttgtaatgaaaaccacattggagatgtttagtaatcatattgttactggtaccaagactactagggaaatgcctttgtactttagggaagtacttttggcattttactgtacagacagaaaaaactgagatgtagcccctctcctggaagtgctaattttgaaaaactgctcatatgatgtacatgtactgattactgcctattttaataaacactcttgaaaaatgcatgttgccctgttgctgcctgccctattctcctcatctccccatcattggtacccacttgcttttaaaatccactttatcttgaataatgtaagacaaatatgttctgacataagtatttaattcatgttgccttgcataatggtcagaggcgcatgaatttgtgaaggtggaaataaactatttgtaaagtgaaaaaaaaaaaaaaa

SEQ ID NO: 37 - DNA, 509 bp, Homo sapiens
attctttccccaagtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataaaaaaaaaaaaa

SEQ ID NO: 38 - DNA, 957 bp, Homo sapiens
gcgcgtcggcgtggggcgctatgccggggcggcacgtttctcgagtccgggcattgtacaagcgcgtcttgcagctgcaccgtgttctgcccccggacctcaaatccctgggcgaccagtacgtgaaagacgaatttaggagacataagaccgttggttctgacgaggcacagcgtttcttgcaagaatgggaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtataaaattcagttttggaactaaacagcaaatttctagaattttgctgaaaatgttttaaaatgctattctcatccagccatattagtcttctggcttttctttagcttcatcaaataagcatgttgtgataatgatagatgtacaattccaacaaggttattattttttaaatacattgtcattctgaacattttatcacttctagtttaataatacatacatgatttttcttctgaatgtctcttctccctgcatcactgttcattcacaatgaaaggttaggaagaagctttaaaattcactattttactatcaatcatttgtataataaactatacaaagtataaaaaaaaaaaaa

SEQ ID NO: 39 - DNA, 1994 bp, Homo sapiens
aaacttcccgcacgcgttacaggagccaggtcggtataagcgccagcggcctcgccgcccgtcaagctgtccacatccctggcctcagcccgccacatcaccctgacctgcttacgcccagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatct

SEQ ID NO: 40 - DNA, 2348 bp, Homo sapiens
cctttctgtcctggttccctgaagcatcgagagggaaccgcggccggcaggccggaccgctccggagaggaggcagcggcagtttgagcccctgtaaatgttatatgtgtacttttttttactatgtggcgtcgaagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaaaaaaaaaaaaaaaaaaaaaaaaaaaaaaaaaaaaaaaaaaaaaaaaaaaaaaaaaa

SEQ ID NO: 41 - DNA, 2345 bp, Homo sapiens
cgcaggcatgatgaaacttcccgcacgcgttacaggagccaggtcggtataagcgccagcggcctcgccgcccgtcaagctgtccacatccctggcctcagcccgccacatcaccctgacctgcttacgcccagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaaaaaaaaaaaaaaaaaaaaaaaaaaaaaaaaaaaaaaaaaaaaaaaaaaaaaaaaaa

SEQ ID NO: 42 - DNA, 5602 bp, Homo sapiens
gcggcgggagcgcggcttcccaggcccgccgctccgcagggctgctggcgttgctgctgttgagaggcggcggcggcggcgcaggcgggcgggaaggatggtgtttctgcgactggagcggcaggtgcggaccgggagccggaccgaggtttggcagaagcaacgtgtgctcgggagcaaccggcgcgggtgccactgaggcagcggagggaggcaggatcgactgacgggcgaacggacggacggacggaaggcgactcgagggccggccccggagccgcgccgtgggcgagatgccggggccgccggcgttgcggcggaggctgctgctgctgctgctggtcctcctgatcgccggcagtgctggggccgcgccacttccgcaaacaggtgcaggggaggcgccacctgctgcagaagtttcctcatcttttgtgatcctgtgtgtgtgcagtttaataatattaatagtgttaattgcaaactgtgtatcctgctgtaaggacccagaaatagactttaaggaatttgaagataattttgatgatgagatagatttcacaccaccagcagaagacactccctctgttcagtccccagcagaggtcttcacactttcagtaccaaatatttcactcccagctccctcgcaattccagccttctgtagagggattgaagtctcaagttgcccgccacagtctaaactacatacaggaaattggaaatggctggtttggaaaggttctcttgggagagatttacacgggcactagcgtagcaagagtcatcgtgaaggagttaaaagcaagtgccaacccaaaggaacaagatacttttttgaaaaatggagaaccttactacattcttcagcatccaaatattcttcagtgtgttggacagtgcgtagaagcgattccctacctcctggtgtttgagttctgtgacttgggtgacctgaaggcgtatctgcgcagcgagcaggagcacatgcggggggactcacagaccatgctgctgcagaggatggcgtgcgaggtcgccgcggggctggccgccatgcacaagctgcacttcctgcacagtgatttagccctgcggaattgttttctcacctccgacttaaatgtgaaagtgggagattacggaataggattcagcaggtacaaggaggattatattgaaacagatgataaaaaagttttccctctgcgatggactgctccagaattagtaaccagctttcaagacagactgctaactgcagatcagactaagtatagtaatatctggtctctgggtgtgacactttgggagctttttgacaatgccgcacagccgtattcaaacctttccaacttagatgtcctcaaccaagtcattagagagagagacacaaaactcccgaagccccagctggagcagccctactctgatagatggtatgaagtcttacagttctgttggctgtcaccagaaaagagacccgcggctgaagatgtgcacaggctgctgacttacctgcggctgcagagccagcgggactcagaggtcgactttgaacagcagtggaacgctctgaagccgaacacaaacagcagagactcctccaacaatgctgcattcccaattctcgaccactttgccagggaccggctgggtcgtgaaatggaggaagtcctcaccgtgaccgaaaccagccagggcctgagcttcgagtatgtctgggaggccgctaagcacgaccactttgacgagcgcagccggggccacctggacgaaggcttgtcctacacgagcatcttctatccggttgaagtttttgagagttcgctttcagatcctgggcccggaaagcaagatgacagcggccaggatgtccccctgagggtccctggagtggttcctgtttttgatgcccacaacctttctgttggaagcgactattatatccagttagaagaaaaaagtggtagtaacttggagcttgattacccaccagcgctgctcacaaccgacatggataatccagaaaggactggccctgaactgtcccagctcacggcgctcaggagcgttgaacttgaggagtccagtacagatgaggacttcttccaaagcagtacagaccccaaagactctagcttaccaggggacttacacgtgaccagtggccccgagagccctttcaacaatatatttaatgatgtggacaaatcggaagatttgcccagtcaccaaaaaatattcgacttaatggaattaaacggagttcaagccgactttaaacctgccactttaagttccagtttggataaccccaaagagtcagtcataacaggccactttgagaaagaaaagccccgtaagatttttgacagtgagcctctctgcctatcagataatcttatgcaccaagataattttgatccattgaatgttcaagaattgtcagaaaactttttatttcttcaagagaaaaacttactaaaaggctcattgtccagcaaagaacacataaatgatcttcagacagaacttaagaatgctggttttactgaagctatgttagaaacgtcatgtagaaactctttagatactgagcttcagtttgctgaaaataagccaggcttgtctttgttgcaggaaaacgtaagcacaaagggtgacgatacagatgtcatgctcacaggtgacactttgagcacctcattgcagtcttccccggaagtgcaggtacctcctacctccttcgaaacagaagaaacgccccgtcgggtacccccagactcactcccaacacagggagaaacccagcccacgtgtttagatgttattgtcccggaggactgtctccaccaggacatcagtccagacgctgtgactgtcccggttgaaattctctcaactgatgccagaacccacagcctggataacaggtcccaggactctcctggcgagagtgaggagaccctgcgactcaccgaaagtgactctgttcttgctgatgacatccttgccagcagggtgagtgtagggagtagtctcccggaactgggacaggaattgcacaataaaccattttcggaagaccatcacagtcatcgccggctagagaaaaacttagaggctgtggagactttaaatcagctcaattctaaagacgcagcaaaagaagcaggcttggtgtctgccctctcctcggactcaaccagtcaggacagcctcctggaggacagcttgtcagcacccttcccagcctctgagccgtccctggaaaccccggactctctggagtcagtggatgtccacgaagcgctactggactctttaggatctcacactccccagaaactagtgccccccgataagccggcagacagtggctacgaaacagagaacttggagtctcccgagtggaccttgcatcccgctcccgagggcaccgcagactcagaaccagccaccacgggcgatggcggccacagcggtctgcctcccaacccggtcattgtcatctcagatgccggcgatggtcacagaggcacagaagtgacccctgagacgttcacagctggctcccagggttcataccgagactctgcgtacttctcagacaatgactctgagcccgagaaaaggtctgaggaggtcccgggaacctccccatccgccttggtgttggtacaggagcagcccctacccgagccagtcctccccgagcaaagtcctgctgcccaggatagctgcctggaagccagaaagagccagccagatgaaagttgtctgtctgctttgcacaactccagtgacctggaattaagagccacgccggagccagcacagactggtgttccccagcaggtgcatcccacggaagacgaggccagcagtccctggagtgtgctgaatgcagaacttagcagcggcgatgacttcgagacacaggacgatcgcccctgcaccctcgcttccacggggaccaacacgaacgaactccttgcctacaccaattctgcgctggacaagtccctgtccagccactccgagggcccgaagttgaaggagccggacatcgaagggaagtacctggggaaactcggggtgtcagggatgctcgacctctcagaggacgggatggatgcagacgaggaggacgaaaacagcgacgactcggacgaggacctgcgggccttcaacctgcatagcctcagctccgagtcggaggacgagaccgagcaccccgtgcccatcatcctcagcaacgaggacggaaggcacctgcggagtctgttgaagcccacagcggccaatgcccccgacccactgcccgaggactggaagaaggaaaagaaggcagtcacgtttttcgatgatgtcacagtctacctgtttgaccaggagaccccaaccaaagagctggggccctgtggaggagaggcgtgcggcccggacctgagcggcccagccccagcctcaggctctccctacctgagcaggtgcatcaactccgaaagctccaccgacgaagaaggtggtggctttgagtgggatgatgacttctccccagatccttttatgtcaaagacaacaagtaacctgctcagctccaagccttctctccaaacatccaagtacttttctccgccgccaccggcccggagcacggagcagagctggccgcactcggcgccttactcccggttctccatctctcccgccaacattgccagcttttccctcacacacctgaccgactcggacatcgagcagggcggaagcagcgaagacggagaaaaggactaggtggctgccaacgcgcacgctcgggtccgaggctgctcccctggagcggcgcccctgcgccctcagcccgagcagcgacatccactcgccatttgctgacatgagattgggaggaagaatccagaggtgaagagggagacggctcttagctgcgttcaaggcggggccctcgggagcccaggtgcagagcgaggccgtgtccaggagccggcgtccctcagtgccccgtgcacccgcggccgcggcctcccaggcagtgctcatgcgctggccgtcgggggaggcaggggcacagcctccatgtgcgcgcgcgtgtggagctgtgtgcaccgcatgtgtgctttccacaggggcgtctctgcgtccacgcctgcacatcccggcgcacgtgtgggcaccacagaggacacgtgaggggaatggtcaccagtgagccatatttattatttctagagaaatcacgaactgctttctgtaattgcactgtggataaatgttccgagagtctccattgttgtacaggatcttcagttattcgaggggaatgaggcaggtcaagccgatgctagccactagtttgattttttttctgttttatagtttgcgctgcatggtacttgtgaagcttaaatattttgagtgttctactgtgtctaggattgttgggattgtacatatggtactctttcataaatgataaatgattctgaatgttagtgttttatgttcatataggaaatattttcattgagtccaaaataccactgttttgttgatggacttgaatgcatttttgt

SEQ ID NO: 43 - DNA, 12563 bp, Homo sapiens
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagcttatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccaggcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggcacgcgggaatgtgaagggcgctccgggctctgagcccgcagcttttacgacttctccctgcgtcgttccttatattcacagaagccccatagtttcactgggttgcggttattttcctggtagtttgcgtgtaagaaagggagaatatagttttagaggaagctgaactatgacgatgctgggcgaacggtttgggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggaggccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgattttttttt

SEQ ID NO: 44 - DNA, 5737 bp, Homo sapiens
ggcagcggcggaagcggcgagggcggcgggcgtccggctctgaggtggtggaggcggcggaggcggcggcggaggcggcggcggctcgggactgggctcggctggaagcagcgagggtcagagcgccgcagcaagcgccgatctcccggctcgaccatccgcctgccgcccggacgcctgggccgcggagtttgtgtcccggctcggaccccggcgcccagcccggagccgtaaccttgaggcggcggcggcggggccgggccgggccgggctggggggcggtggcgctggatccgcggctgcccgatcgttggcgggagatgtcgaaccccgggacacgcaggaacggctccagcatcaagatccgtctgacagtgttatgtgccaagaaccttgcaaagaaagacttcttcaggctccctgacccttttgcaaagattgtcgtggatgggtctgggcagtgccactcaaccgacactgtgaaaaacacattggacccaaagtggaaccagcactatgatctatatgttgggaaaacggattcgataaccattagcgtgtggaaccataagaaaattcacaagaaacagggagctggcttcctgggctgtgtgcggctgctctccaatgccatcagcagattaaaagataccggataccagcgtttggatctatgcaaactaaacccctcagatactgatgcagttcgtggccagatagtggtcagtttacagacacgagacagaataggaaccggcggctcggtggtggactgcagaggactgttagaaaatgaaggaacggtgtatgaagactccgggcctgggaggccgctcagctgcttcatggaggaaccagccccttacacagatagcaccggtgctgctgctggaggagggaattgcaggttcgtggagtccccaagtcaagatcaaagacttcaggcacagcggcttcgaaaccctgatgtgcgaggttcactacagacgccccagaaccgaccacacggccaccagtccccggaactgcccgaaggctacgaacaaagaacaacagtccagggccaagtttactttttgcatacacagactggagttagcacgtggcacgaccccaggataccaagtccctcggggaccattcctgggggagatgcagcttttctatacgaattccttctacaaggccatacatctgagcccagagaccttaacagtgtgaactgtgatgaacttggaccactgccgccaggctgggaagtcagaagtacagtttctgggaggatatattttgtagatcataataaccgaacaacccagtttacagacccaaggttacaccacatcatgaatcaccagtgccaactcaaggagcccagccagccgctgccactgcccagtgagggctctctggaggacgaggagcttcctgcccagagatacgaaagagatctagtccagaagctgaaagtcctcagacacgaactgtcgcttcagcagccccaagctggtcattgccgcatcgaagtgtccagagaagaaatctttgaggagtcttaccgccagataatgaagatgcgaccgaaagacttgaaaaaacggctgatggtgaaattccgtggggaagaaggtttggattacggtggtgtggccagggagtggctttacttgctgtgccatgaaatgctgaatccttattacgggctcttccagtattctacggacaatatttacatgttgcaaataaatccggattcttcaatcaaccccgaccacttgtcttatttccactttgtggggcggatcatggggctggctgtgttccatggacactacatcaacgggggcttcacagtgcccttctacaagcagctgctggggaagcccatccagctctcagatctggaatctgtggacccagagctgcataagagcttggtgtggatcctagagaacgacatcacgcctgtactggaccacaccttctgcgtggaacacaacgccttcgggcggatcctgcagcatgaactgaaacccaatggcagaaatgtgccagtcacagaggagaataagaaagaatacgtccggttgtatgtaaactggaggtttatgagaggaatcgaagcccagttcttagctctgcagaaggggttcaatgagctcatccctcaacatctgctgaagccttttgaccagaaggaactggagctgatcataggcggcctggataaaatagacttgaacgactggaagtcgaacacgcggctgaagcactgtgtggccgacagcaacatcgtgcggtggttctggcaagcggtggagacgttcgatgaagaaaggagggccaggctcctgcagtttgtgactgggtccacgcgagtcccgctccaaggcttcaaggctttgcaaggttctacaggcgcggcagggccccggctgttcaccatccacctgatagacgcgaacacagacaaccttccgaaggcccatacctgctttaaccggatcgacattccaccatatgagtcctatgagaagctctacgagaagctgctgacagccgtggaggagacctgcgggtttgctgtggagtgaaaagcaaccaaaggcaacagagtctagctcatggccaccagaccaaaagcatccagcttctgtgcacctcctgcaaagctggcagaggccctggaattccagatcacctgaggggaaagggttgtctctctcctttctgttgggggagggggatgggggacttttgttggtggctcccacccatatatccctcctttaccatagtactcccacccacttccatcacccatccaataaaatgcagccaggtttagcctttggctttggtcacacaggatattctgctgtgttgcaacccatgtggtgataaggctcacagccctgagctctttacgggagcatcaactcacagttaggggactgggcgtggctgattgagggtttggaactggtggctatgccagctattccatctcaaaacagccttgaggccccttttcaatttgagcagctgctagatatcttatcagagctcagattccagatttcacatcccagcagccggttctgggtagcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccagtttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtccgcgcgaagcccactcacgtgtgatctgtgttgcccctctcggtggtcccaggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgacttt

SEQ ID NO: 45 - DNA, 5659 bp, Homo sapiens
ggcagcggcggaagcggcgagggcggcgggcgtccggctctgaggtggtggaggcggcggaggcggcggcggaggcggcggcggctcgggactgggctcggctggaagcagcgagggtcagagcgccgcagcaagcgccgatctcccggctcgaccatccgcctgccgcccggacgcctgggccgcggagtttgtgtcccggctcggaccccggcgcccagcccggagccgtaaccttgaggcggcggcggcggggccgggccgggccgggctggggggcggtggcgctggatccgcggctgcccgatcgttggcgggagatgtcgaaccccgggacacgcaggaacggctccagcatcaagatccgtctgacagtgttatgtgccaagaaccttgcaaagaaagacttcttcaggctccctgacccttttgcaaagattgtcgtggatgggtctgggcagtgccactcaaccgacactgtgaaaaacacattggacccaaagtggaaccagcactatgatctatatgttgggaaaacggattcgataaccattagcgtgtggaaccataagaaaattcacaagaaacagggagctggcttcctgggctgtgtgcggctgctctccaatgccatcagcagattaaaagataccggataccagcgtttggatctatgcaaactaaacccctcagatactgatgcagttcgtggccagatagtggtcagtttacagacacgagacagaataggaaccggcggctcggtggtggactgcagaggactgttagaaaatgaaggaacggtgtatgaagactccgggcctgggaggccgctcagctgcttcatggaggaaccagccccttacacagatagcaccggtgctgctgctggaggagggaattgcaggttcgtggagtccccaagtcaagatcaaagacttcaggcacagcggcttcgaaaccctgatgtgcgaggttcactacagacgccccagaaccgaccacacggccaccagtccccggaactgcccgaaggctacgaacaaagaacaacagtccagggccaagtttactttttgcatacacagactggagttagcacgtggcacgaccccaggataccaagagaccttaacagtgtgaactgtgatgaacttggaccactgccgccaggctgggaagtcagaagtacagtttctgggaggatatattttgtagatcataataaccgaacaacccagtttacagacccaaggttacaccacatcatgaatcaccagtgccaactcaaggagcccagccagccgctgccactgcccagtgagggctctctggaggacgaggagcttcctgcccagagatacgaaagagatctagtccagaagctgaaagtcctcagacacgaactgtcgcttcagcagccccaagctggtcattgccgcatcgaagtgtccagagaagaaatctttgaggagtcttaccgccagataatgaagatgcgaccgaaagacttgaaaaaacggctgatggtgaaattccgtggggaagaaggtttggattacggtggtgtggccagggagtggctttacttgctgtgccatgaaatgctgaatccttattacgggctcttccagtattctacggacaatatttacatgttgcaaataaatccggattcttcaatcaaccccgaccacttgtcttatttccactttgtggggcggatcatggggctggctgtgttccatggacactacatcaacgggggcttcacagtgcccttctacaagcagctgctggggaagcccatccagctctcagatctggaatctgtggacccagagctgcataagagcttggtgtggatcctagagaacgacatcacgcctgtactggaccacaccttctgcgtggaacacaacgccttcgggcggatcctgcagcatgaactgaaacccaatggcagaaatgtgccagtcacagaggagaataagaaagaatacgtccggttgtatgtaaactggaggtttatgagaggaatcgaagcccagttcttagctctgcagaaggggttcaatgagctcatccctcaacatctgctgaagccttttgaccagaaggaactggagctgatcataggcggcctggataaaatagacttgaacgactggaagtcgaacacgcggctgaagcactgtgtggccgacagcaacatcgtgcggtggttctggcaagcggtggagacgttcgatgaagaaaggagggccaggctcctgcagtttgtgactgggtccacgcgagtcccgctccaaggcttcaaggctttgcaaggttctacaggcgcggcagggccccggctgttcaccatccacctgatagacgcgaacacagacaaccttccgaaggcccatacctgctttaaccggatcgacattccaccatatgagtcctatgagaagctctacgagaagctgctgacagccgtggaggagacctgcgggtttgctgtggagtgaaaagcaaccaaaggcaacagagtctagctcatggccaccagaccaaaagcatccagcttctgtgcacctcctgcaaagctggcagaggccctggaattccagatcacctgaggggaaagggttgtctctctcctttctgttgggggagggggatgggggacttttgttggtggctcccacccatatatccctcctttaccatagtactcccacccacttccatcacccatccaataaaatgcagccaggtttagcctttggctttggtcacacaggatattctgctgtgttgcaacccatgtggtgataaggctcacagccctgagctctttacgggagcatcaactcacagttaggggactgggcgtggctgattgagggtttggaactggtggctatgccagctattccatctcaaaacagccttgaggccccttttcaatttgagcagctgctagatatcttatcagagctcagattccagatttcacatcccagcagccggttctgggtagcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccagtttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtccgcgcgaagcccactcacgtgtgatctgtgttgcccctctcggtggtcccaggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgacttt

SEQ ID NO: 46 - DNA, 12563 bp, Homo sapiens; identical to SEQ ID NO: 43

SEQ ID NO: 47 - DNA, 5737 bp, Homo sapiens; identical to SEQ ID NO: 44

SEQ ID NO: 48 - DNA, 5659 bp, Homo sapiens; identical to SEQ ID NO: 45

SEQ ID NO: 49 - DNA, 1619 bp, Homo sapiens
tcagccgctccctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtggaaaaaaaaaaaaaaaaaaaaaaaaaa

SEQ ID NO: 50 - DNA, 1520 bp, Homo sapiens
ggctgctgctccggcgcggagcccagagccggttcggcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaaaatgcccccaaagcactatgctggtcatgaactgcttcaaaatgtggaggtaataaaatgcaactgtgtaaaaaaaaaaaaaaaaaaaaaa

SEQ ID NO: 51 - DNA, 4312 bp, Homo sapiens
gggctgtttgaatggctttgggatggagcaggggagagagtggctccgtttgcctccccgctttggtgatgctgtgcgagcggcttcgggggccctggagacgtccgagtcactgagggtgggctgggactcggggcccgcgtcccatctccccgccgattggtccgccccccgtgcgagtgtaacacagccagcctcgaagacttccctctgagttggaatgataatgaccgaatcccgagaagttatagacttagaccccccagctgagacttcccaggagcaggaagaccttttcatagtgaaggtggaagaagaagactgcacctggatgcaggagtacaacccgccaacgtttgagactttttaccagcgcttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatgcccttcctgttctccaagttccttcccttcccctgaaggacagccaggagctgacagcttcacttctctcaactgggtcccagaagttggtgaaaattgaagaggtggctgatgtggctgtatccttcatcctggaggaatgggggcatttggaccagtcccagaagtccctttatagggatgacaggaaggagaactatgggagtattacttccatgggttatgagtccagggacaatatggagctcatagtgaagcagatttctgatgactctgaatcacactgggtggcgccagaacacaccgaaaggagcgttcctcaggatccagactttgcagaagtcagtgaccttaaaggcatggtacaaaggtggcaggtcaaccccactgtggggaaatcaaggcagaatccttcccagaaaagggatctggatgcaatcacagacatcagccctaagcaaagcacacatggcgagagagggcacagatgcagcgattgtggcaaattcttcctccaagcctcaaactttattcagcatcggcgcatccacactggagaaaaaccgtttaagtgcggagaatgtgggaagagctacaatcagcgggtgcacctcacccagcaccagcgcgtccacacaggggagaaaccctacaaatgtcaggtgtgcggaaaggctttccgggtgagttcccacctggttcagcaccacagtgtccacagcggagagaggccctatggctgcaatgagtgtgggaagaacttcggtcgccattcgcatctgatcgaacacctaaaacgccacttcagggagaaatcccagagatgcagtgacaaaagaagtaagaacacaaaattaagtgttaagaagaaaatttcagaatattcagaagcagacatggaactatctggaaaaacccaaagaaatgtttctcaagttcaagattttggagaaggctgtgagtttcaaggcaagctggatagaaagcagggaattcccatgaaagagatactaggacaaccatcttcaaagaggatgaactacagtgaagtcccatatgtccacaaaaaatcctccactggagagagaccacataaatgtaacgagtgtgggaaaagcttcattcagagtgcacatcttattcaacatcaaagaatacacactggggagaaaccattcaggtgtgaggaatgtgggaaaagctacaaccaacgcgtgcacctaactcagcatcagcgcgtccacacaggtgagaagccctacacctgtcccttatgtgggaaagccttcagagtgaggtcccaccttgttcagcatcagagcgtgcacagtggggagagacccttcaagtgtaacgaatgtgggaaaggctttgggaggcgttcccacctggctggacatcttcgactccactcccgagagaaatcccatcagtgtcgtgaatgtggggaaatcttttttcagtacgttagcctaattgaacatcaggtgctccacatgggtcagaaaaatgaaaaaaatggcatctgtgaggaagcatatagttggaacttgacagtgattgaagacaagaagattgagttacaagagcagccttatcagtgtgatatctgtggaaaagcctttggttatagctcagacctcattcagcattacagaactcatacagcagagaagccctatcaatgtgatatatgtagagaaaatgttggccagtgttcccacaccaaacaacatcaaaaaatctactccagcacaaaatcccatcaatgtcatgaatgtggcagaggcttcactctgaagtcacatcttaatcaacatcagagaatccatactggtgagaaaccttttcaatgtaaagaatgtggaatgaatttcagctggagttgtagcctctttaaacacctgagaagccatgagaggacagatcccataaataccttaagtgtagaggggtctctgttgtagaatagctcttaattttagagaaaccttcctggagggaaaccatactcctataatgagcaaagtaacaacttcaagcatttttccagcgttaccatcaaactcacaaataggttgaaatcctttagttataactcagcctttaggaacaccggagaacccacaataatagaaatcttttcgtgttccccattgagaaatgctttagttagcatcttcatgcttggaaatctagacaagaagagaatccatggatggacatggtcgaggaattcggaaagcctgcagttgacattcagtcttcacttgaaactcaaaactgacactaggaacagcttcatgagttcagtagaagtaagctttatttgtagcttctgccttgtttgacggcgtatctattcagggaagcgcacagtaaaagaattccttagcatgatgtctgttttggtacctcagcaatgaaccttttctagaaattattattccaaccactagaataccctagtcactattcccactttgagcattaacccctttgaaaagaaatggacttaaagtatctctgttttggcaaaattcaggttcaggggctggatggtatgtgtttctgctgccttattcaatccaccacttctctgtgaaacactctaccttgtttttggtttgattctactgatgtcagggtttagccggtagaaggagtagttcagtttgtcaattcaggagaaactgtactggtcagtcacatcttacggcgaagggagagggaccttaggggagcagagaagacaggcaaagttgtggactgtttgatcttgtattacccacaggaatgagggcagctaaacccatagaaggagttggaccaaggcgaattacgagtcctggtcccagcagtatgtgtgctgacttctgggtgccccagaaatagacctctcctgtagagtggtgatatacagaatgagtttcagtttgcattgcagctgggattgaaagtaatcagtcgtgagcaggcaggcaggaggtcctgttagccctgccttccaggaaggttggggtgggagttttgagtgggaaagaggatgacatgtgtgagagagttctgagcctgtttgctagggagagtgagtgagtgctcttgggcactgctcaggccgtttctgctgacttgcctggcttacaataaatgcccaataaatatttgttgaccatatgtgttgtacactgtggtgccctgtccagtcccctctaccaagctgagacccccatccccagctgctctgagtttgggctgcaagtgctcacagctcttgttctccagaaactggagaattgccctcaggagatgagagccatctcacctcacccaggagtcacttcctctctacaccccaacacctggttcatttgattaaagcggagaaaactccagggtgctatgactgctctggcacccttggatcaggccaagctagactttttctgagccttcatccgtgctaagctctctcccttctctatcctgtttcattccctccctcaaaggcgtttcccaaataaatcacactgtcaatc

SEQ ID NO: 52 - DNA, 4193 bp, Homo sapiens
gcgactcgcgggtgtgacgttgaagatgtcggccttctgagccgactgcggtggtcaagagtgtaacacagccagcctcgaagacttccctctgagttggaatgataatgaccgaatcccgagaagttatagacttagaccccccagctgagacttcccaggagcaggaagaccttttcatagtgaaggtggaagaagaagactgcacctggatgcaggagtacaacccgccaacgtttgagactttttaccagcgcttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatgcccttcctgttctccaagttccttcccttcccctgaaggacagccaggagctgacagcttcacttctctcaactgggtcccagaagttggtgaaaattgaagaggtggctgatgtggctgtatccttcatcctggaggaatgggggcatttggaccagtcccagaagtccctttatagggatgacaggaaggagaactatgggagtattacttccatgggttatgagtccagggacaatatggagctcatagtgaagcagatttctgatgactctgaatcacactgggtggcgccagaacacaccgaaaggagcgttcctcaggatccagactttgcagaagtcagtgaccttaaaggcatggtacaaaggtggcaggtcaaccccactgtggggaaatcaaggcagaatccttcccagaaaagggatctggatgcaatcacagacatcagccctaagcaaagcacacatggcgagagagggcacagatgcagcgattgtggcaaattcttcctccaagcctcaaactttattcagcatcggcgcatccacactggagaaaaaccgtttaagtgcggagaatgtgggaagagctacaatcagcgggtgcacctcacccagcaccagcgcgtccacacaggggagaaaccctacaaatgtcaggtgtgcggaaaggctttccgggtgagttcccacctggttcagcaccacagtgtccacagcggagagaggccctatggctgcaatgagtgtgggaagaacttcggtcgccattcgcatctgatcgaacacctaaaacgccacttcagggagaaatcccagagatgcagtgacaaaagaagtaagaacacaaaattaagtgttaagaagaaaatttcagaatattcagaagcagacatggaactatctggaaaaacccaaagaaatgtttctcaagttcaagattttggagaaggctgtgagtttcaaggcaagctggatagaaagcagggaattcccatgaaagagatactaggacaaccatcttcaaagaggatgaactacagtgaagtcccatatgtccacaaaaaatcctccactggagagagaccacataaatgtaacgagtgtgggaaaagcttcattcagagtgcacatcttattcaacatcaaagaatacacactggggagaaaccattcaggtgtgaggaatgtgggaaaagctacaaccaacgcgtgcacctaactcagcatcagcgcgtccacacaggtgagaagccctacacctgtcccttatgtgggaaagccttcagagtgaggtcccaccttgttcagcatcagagcgtgcacagtggggagagacccttcaagtgtaacgaatgtgggaaaggctttgggaggcgttcccacctggctggacatcttcgactccactcccgagagaaatcccatcagtgtcgtgaatgtggggaaatcttttttcagtacgttagcctaattgaacatcaggtgctccacatgggtcagaaaaatgaaaaaaatggcatctgtgaggaagcatatagttggaacttgacagtgattgaagacaagaagattgagttacaagagcagccttatcagtgtgatatctgtggaaaagcctttggttatagctcagacctcattcagcattacagaactcatacagcagagaagccctatcaatgtgatatatgtagagaaaatgttggccagtgttcccacaccaaacaacatcaaaaaatctactccagcacaaaatcccatcaatgtcatgaatgtggcagaggcttcactctgaagtcacatcttaatcaacatcagagaatccatactggtgagaaaccttttcaatgtaaagaatgtggaatgaatttcagctggagttgtagcctctttaaacacctgagaagccatgagaggacagatcccataaataccttaagtgtagaggggtctctgttgtagaatagctcttaattttagagaaaccttcctggagggaaaccatactcctataatgagcaaagtaacaacttcaagcatttttccagcgttaccatcaaactcacaaataggttgaaatcctttagttataactcagcctttaggaacaccggagaacccacaataatagaaatcttttcgtgttccccattgagaaatgctttagttagcatcttcatgcttggaaatctagacaagaagagaatccatggatggacatggtcgaggaattcggaaagcctgcagttgacattcagtcttcacttgaaactcaaaactgacactaggaacagcttcatgagttcagtagaagtaagctttatttgtagcttctgccttgtttgacggcgtatctattcagggaagcgcacagtaaaagaattccttagcatgatgtctgttttggtacctcagcaatgaaccttttctagaaattattattccaaccactagaataccctagtcactattcccactttgagcattaacccctttgaaaagaaatggacttaaagtatctctgttttggcaaaattcaggttcaggggctggatggtatgtgtttctgctgccttattcaatccaccacttctctgtgaaacactctaccttgtttttggtttgattctactgatgtcagggtttagccggtagaaggagtagttcagtttgtcaattcaggagaaactgtactggtcagtcacatcttacggcgaagggagagggaccttaggggagcagagaagacaggcaaagttgtggactgtttgatcttgtattacccacaggaatgagggcagctaaacccatagaaggagttggaccaaggcgaattacgagtcctggtcccagcagtatgtgtgctgacttctgggtgccccagaaatagacctctcctgtagagtggtgatatacagaatgagtttcagtttgcattgcagctgggattgaaagtaatcagtcgtgagcaggcaggcaggaggtcctgttagccctgccttccaggaaggttggggtgggagttttgagtgggaaagaggatgacatgtgtgagagagttctgagcctgtttgctagggagagtgagtgagtgctcttgggcactgctcaggccgtttctgctgacttgcctggcttacaataaatgcccaataaatatttgttgaccatatgtgttgtacactgtggtgccctgtccagtcccctctaccaagctgagacccccatccccagctgctctgagtttgggctgcaagtgctcacagctcttgttctccagaaactggagaattgccctcaggagatgagagccatctcacctcacccaggagtcacttcctctctacaccccaacacctggttcatttgattaaagcggagaaaactccagggtgctatgactgctctggcacccttggatcaggccaagctagactttttctgagccttcatccgtgctaagctctctcccttctctatcctgtttcattccctccctcaaaggcgtttcccaaataaatcacactgtcaatc

SEQ ID NO: 53 - DNA, 1707 bp, Homo sapiens
gggaagctccaggcaaacagcccagcaaacagcagcactcagctaaaaggaagactcacagaacacagttgaagaaggaaagtggcgatggacctcatcccaaatttggcggtggaaacctggcttctcctggctgtcagcctggtgctcctctatctatatgggacccgtacacatggactttttaagagactgggaattccagggcccacacctctgcctttgttgggaaatgttttgtcctatcgtcagggtctctggaaatttgacacagagtgctataaaaagtatggaaaaatgtggggaacgtatgaaggtcaactccctgtgctggccatcacagatcccgacgtgatcagaacagtgctagtgaaagaatgttattctgtcttcacaaatcgaaggtctttaggcccagtgggatttatgaaaagtgccatctctttagctgaggatgaagaatggaagagaatacggtcattgctgtctccaaccttcaccagcggaaaactcaaggagatgttccccatcattgcccagtatggagatgtattggtgagaaacttgaggcgggaagcagagaaaggcaagcctgtcaccttgaaagacatctttggggcctacagcatggatgtgattactggcacatcatttggagtgaacatcgactctctcaacaatccacaagacccctttgtggagagcactaagaagttcctaaaatttggtttcttagatccattatttctctcaataatactctttccattccttaccccagtttttgaagcattaaatgtctctctgtttccaaaagataccataaattttttaagtaaatctgtaaacagaatgaagaaaagtcgcctcaacgacaaacaaaagcaccgactagatttccttcagctgatgattgactcccagaattcgaaagaaactgagtcccacaaagctctgtctgatctggagctcgcagcccagtcaataatcttcatttttgctggctatgaaaccaccagcagtgttctttccttcactttatatgaactggccactcaccctgatgtccagcagaaactgcaaaaggagattgatgcagttttgcccaataaggcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacagatccccttgaaattagacacgcaaggacttcttcaaccagaaaaacccattgttctaaaggtggattcaagagatggaaccctaagtggagaatgagttattctaaggatttctactttggtcttcaagaaagctgtgccccagaacaccagagatttcaacttagtcaataaaaccttgaaataaagatgggcttaatctaatgta

SEQ ID NO: 54 - DNA, 1707 bp, Homo sapiens; identical to SEQ ID NO: 53

SEQ ID NO: 55 - DNA, 1818 bp, Homo sapiens
ggggtagtgcaggcgccgggtttcccgcggtccgagctggcgcggggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatgcatcaccatggccgtcatttcattcacatcagacacagcggcctctatttggtggtcacaacttcagaaaacgtttctcccttcagcctcctagaactgctctccaggttggccacccttctgggcgattactgtggctccctgggcgaggggaccatctcccgcaatgtggctctggtatacgaactcctggatgaagtgctggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatggatccctgctgaaggtggatgtgcagggagagattcggctcaagagcttccttcctagcggctctgagatgcgcattggcttgacggaagagttttgtgtggggaagtcagagctgagaggttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcagcctgtctcaggagctgagcagcccagagcagaaggctgagctggcagagggagcccttcgctgggacctgcctcgggtgcaaggaggctctcaactctcaggccttttccagatggacgtcccagggcccccaggacctcccagccatgggctctccacctcggcctctcctctggggctgggccctgccagtctctccttcgagcttccccggcacacgtgctctggcctccaggtccgattcctcaggctggccttcaggccatgcggcaatgccaacccccacaagtgggtgcgacacctaagccacagcgacgcctatgtcattcggatctgaggctccccaaacgaggacacgacggccaaggtggcagtttgtcccacgggaggacagtcgtttcttttccagcctcctggccttcggactctgaatctgggcaggaagagtcctcagtcccaagaccaggagggggcaatgggcccagcctttctgtggtatctgatgcaggaaggactgcagtggatcagaacttacaaaccaaacttttattctgagaaactggctgtacaatatctaaaaagaaagtgacatgaaggaagcaatctacaacttccttccgcttagcgagcatgc

SEQ ID NO: 56 - DNA, 2737 bp, Homo sapiens
gcggggccaagatggcgccgagcgccgggtgagcagcgtctcggctgccgctagagttttcctgctccccgcgctcgggtggcgggggcgggtctgagtggtaccccggaggagaccctttgaaggtcccttgtggggactggaaagaggacggttggttgtgtgtctgtgctcgtggggaccccgtgtgtgtgcctgcattggagagatgttgcaggagatggggtgggctctctgaacctcctttcgcgctgcccggggatcttcgacctgcttctctgctgggatctcgcttaagttaacccttccctgggacgccttcctgccgcctccactgatctgaggagatcctgtgactgtagcgtgttttatgagcctttactggcagagggtaccgccgggtattgaaggattcgtaggagttcgccagggaagtgggacacgaccccctcttgtaaacccggcgccaggcacagaggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcattggctgagcatcgagggctgccagccagctatccccgagaacccgcccccagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggaagccctgcaaagcattgccacggaccctggactgtatcagatgctgccacggttcagtacctttatctcggagggggtccgtgtgaacgtggttcagaacaacctggccctactcatctacctgatgcgtatggtgaaagcgctgatggacaaccccacgctctatctagaaaaatacgtccatgagctgattccagctgtgatgacctgcatcgtgagcagacagttgtgcctgcgaccagatgtggacaatcactgggcactccgagactttgctgcccgcctggtggcccagatctgcaagcattttagcacaaccactaacaacatccagtcccggatcaccaagaccttcaccaagagctgggtggacgagaagacgccctggacgactcgttatggctccatcgcaggcttggctgagctgggacacgatgttatcaagactctgattctgccccggctgcagcaggaaggggagcggatccgcagtgtgctggacggccctgtgctgagcaacattgaccggattggagcagaccatgtgcagagcctcctgctgaaacactgtgctcctgttctggcaaagctgcgcccaccgcctgacaatcaggacgcctatcgggcagaattcgggtcccttgggcccctcctctgctcccaggtggtcaaggctcgggcccaggctgctctgcaggctcagcaggtcaacaggaccactctgaccatcacgcagccccggcccacgctgaccctctcgcaggccccacagcctggccctcgcacccctggcttgctgaaggttcctggctccatcgcacttcctgtccagacactggtgtctgcacgagcggctgccccaccacagccttcccctcctccaaccaagtttattgtaatgtcatcgtcctccagcgccccatccacccagcaggtcctgtccctcagcacctcggcccccggctcaggttccaccaccacttcgcccgtcaccaccaccgtccccagcgtgcagcccatcgtcaagttggtctccaccgccaccaccgcaccccccagcactgctccctctggtcctgggagtgtccagaagtacatcgtggtctcacttcccccaacaggggagggcaaaggaggccccacctcccatccttctccagttcctcccccggcatcgtccccgtccccactcagcggcagtgccctttgtggggggaagcaggaggctggggacagtccccctccagctccagggactccaaaagccaatggctcccagcccaactccggctcccctcagcctgctccgtgatgctccacctgccagcccccggattcccacacatgcagacatgtacacacgtgcacgtacacacatgcatgctcgctaagcggaaggaagttgtagattgcttccttcatgtcactttctttttagatattgtacagccagtttctcagaataaaagtttggtttgt

SEQ ID NO: 57 - DNA, 2383 bp, Homo sapiens
gcggggccaagatggcgccgagcgccgggtgagcagcgtctcggctgccgctagagttttcctgctccccgcgctcgggtggcgggggcgggtctgagtggtaccccggaggagaccctttgaaggtcccttgtggggactggaaagaggacgggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcattggctgagcatcgagggctgccagccagctatccccgagaacccgcccccagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggaagccctgcaaagcattgccacggaccctggactgtatcagatgctgccacggttcagtacctttatctcggagggggtccgtgtgaacgtggttcagaacaacctggccctactcatctacctgatgcgtatggtgaaagcgctgatggacaaccccacgctctatctagaaaaatacgtccatgagctgattccagctgtgatgacctgcatcgtgagcagacagttgtgcctgcgaccagatgtggacaatcactgggcactccgagactttgctgcccgcctggtggcccagatctgcaagcattttagcacaaccactaacaacatccagtcccggatcaccaagaccttcaccaagagctgggtggacgagaagacgccctggacgactcgttatggctccatcgcaggcttggctgagctgggacacgatgttatcaagactctgattctgccccggctgcagcaggaaggggagcggatccgcagtgtgctggacggccctgtgctgagcaacattgaccggattggagcagaccatgtgcagagcctcctgctgaaacactgtgctcctgttctggcaaagctgcgcccaccgcctgacaatcaggacgcctatcgggcagaattcgggtcccttgggcccctcctctgctcccaggtggtcaaggctcgggcccaggctgctctgcaggctcagcagccccggcccacgctgaccctctcgcaggccccacagcctggccctcgcacccctggcttgctgaaggttcctggctccatcgcacttcctgtccagacactggtgtctgcacgagcggctgccccaccacagccttcccctcctccaaccaagtttattgtaatgtcatcgtcctccagcgccccatccacccagcaggtcctgtccctcagcacctcggcccccggctcaggttccaccaccacttcgcccgtcaccaccaccgtccccagcgtgcagcccatcgtcaagttggtctccaccgccaccaccgcaccccccagcactgctccctctggtcctgggagtgtccagaagtacatcgtggtctcacttcccccaacaggggagggcaaaggaggccccacctcccatccttctccagttcctcccccggcatcgtccccgtccccactcagcggcagtgccctttgtggggggaagcaggaggctggggacagtccccctccagctccagggactccaaaagccaatggctcccagcccaactccggctcccctcagcctgctccgtgatgctccacctgccagcccccggattcccacacatgcagacatgtacacacgtgcacgtacacacatgcatgctcgctaagcggaaggaagttgtagattgcttccttcatgtcactttctttttagatattgtacagccagtttctcagaataaaagtttggtttgt

SEQ ID NO: 58 - DNA, 2707 bp, Homo sapiens
gcggggccaagatggcgccgagcgccgggtgagcagcgtctcggctgccgctagagttttcctgctccccgcgctcgggtggcgggggcgggtctgagtggtaccccggaggagaccctttgaaggtcccttgtggggactggaaagaggacggttggttgtgtgtctgtgctcgtggggaccccgtgtgtgtgcctgcattggagagatgttgcaggagatggggtgggctctctgaacctcctttcgcgctgcccggggatcttcgacctgcttctctgctgggatctcgcttaagttaacccttccctgggacgccttcctgccgcctccactgatctgaggagatcctgtgactgtagcgtgttttatgagcctttactggcagagggtaccgccgggtattgaaggattcgtaggagttcgccagggaagtgggacacgaccccctcttgtaaacccggcgccaggcacagaggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcattggctgagcatcgagggctgccagccagctatccccgagaacccgcccccagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggaagccctgcaaagcattgccacggaccctggactgtatcagatgctgccacggttcagtacctttatctcggagggggtccgtgtgaacgtggttcagaacaacctggccctactcatctacctgatgcgtatggtgaaagcgctgatggacaaccccacgctctatctagaaaaatacgtccatgagctgattccagctgtgatgacctgcatcgtgagcagacagttgtgcctgcgaccagatgtggacaatcactgggcactccgagactttgctgcccgcctggtggcccagatctgcaagcattttagcacaaccactaacaacatccagtcccggatcaccaagaccttcaccaagagctgggtggacgagaagacgccctggacgactcgttatggctccatcgcaggcttggctgagctgggacacgatgttatcaagactctgattctgccccggctgcagcaggaaggggagcggatccgcagtgtgctggacggccctgtgctgagcaacattgaccggattggagcagaccatgtgcagagcctcctgctgaaacactgtgctcctgttctggcaaagctgcgcccaccgcctgacaatcaggacgcctatcgggcagaattcgggtcccttgggcccctcctctgctcccaggtggtcaaggctcgggcccaggctgctctgcaggctcagcaggtcaacaggaccactctgaccatcacgcagccccggcccacgctgaccctctcgcaggccccacagcctggccctcgcacccctggcttgctgaaggttcctggctccatcgcacttcctgtccagacactggtgtctgcacgagcggctgccccaccacagccttcccctcctccaaccaagtttattgtaatgtcatcgtcctccagcgccccatccacccagcaggtcctgtccctcagcacctcggcccccggctcaggttccaccaccacttcgcccgtcaccaccaccgtccccagcgtgcagcccatcgtcaagttggtctccaccgccaccaccgcaccccccagcactgctccctctggtcctgggagtgtccagaagtacatcgtggtctcacttcccccaacaggggagggcaaaggaggccccacctcccatccttctccagttcctcccccggcatcgtccccgtccccactcagcggcagtgccctttgtggggggaagcaggaggctggggacagtccccctccagctccagggactccaaaagccaatggctcccagcccaactccggctcccctcagcctgctccgtgatgctccacctgccagcccccggattcccacacatgcagacatgtacacacgtgcacgtacacacatgcatgctcgctaagcggaaggaagttgtagattgcttccttcatgtcactttctttttagatattgtacagccagtttctcagaataaaagtttggtttgt

SEQ ID NO: 59 - DNA, 2441 bp, Homo sapiens
gcggggccaagatggcgccgagcgccgggtgagcagcgtctcggctgccgctagagttttcctgctccccgcgctcgggtggcgggggcgggtctgagtggtaccccggaggagaccctttgaaggtcccttgtggggactggaaagaggacgggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcattggctgagcatcgagggctgccagccagctatccccgagaacccgcccccagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggaagccctgcaaagcattgccacggaccctggactgtatcagatgctgccacggttcagtacctttatctcggagggggtccgtgtgaacgtggttcagaacaacctggccctactcatctacctgatgcgtatggtgaaagcgctgatggacaaccccacgctctatctagaaaaatacgtccatgagctgattccagctgtgatgacctgcatcgtgagcagacagttgtgcctgcgaccagatgtggacaatcactgggcactccgagactttgctgcccgcctggtggcccagatctgcaagcattttagcacaaccactaacaacatccagtcccggatcaccaagaccttcaccaagagctgggtggacgagaagacgccctggacgactcgttatggctccatcgcaggcttggctgagctgggacacgatgttatcaagactctgattctgccccggctgcagcaggaaggggagcggatccgcagtgtgctggacggccctgtgctgagcaacattgaccggattggagcagaccatgtgcagagcctcctgctgaaacactgtgctcctgttctggcaaagctgcgcccaccgcctgacaatcaggacgcctatcgggcagaattcgggtcccttgggcccctcctctgctcccaggtggtcaaggctcgggcccaggctgctctgcaggctcagcaggtcaacaggaccactctgaccatcacgcagccccggcccacgctgaccctctcgcaggccccacagcctggccctcgcacccctggcttgctgaaggttcctggctccatcgcacttcctgtccagacactggtgtctgcacgagcggctgccccaccacagccttcccctcctccaaccaagtttattgtaatgtcatcgtcctccagcgccccatccacccagcaggtcctgtccctcagcacctcggcccccggctcaggttccaccaccacttcgcccgtcaccaccaccgtccccagcgtgcagcccatcgtcaagttggtctccaccgccaccaccgcaccccccagcactgctccctctggtcctgggagtgtccagaagtacatcgtggtctcacttcccccaacaggggagggcaaaggaggccccacctcccatccttctccagttcctcccccggcatcgtccccgtccccactcagcggcagtgccctttgtggggggaagcaggaggctggggacagtccccctccagctccagggactccaaaagccaatggctcccagcccaactccggctcccctcagcctgctccgtgatgctccacctgccagcccccggattcccacacatgcagacatgtacacacgtgcacgtacacacatgcatgctcgctaagcggaaggaagttgtagattgcttccttcatgtcactttctttttagatattgtacagccagtttctcagaataaaagtttggtttgtaagttctgaaaaaaaaaaaaaaaaaaaa

SEQ ID NO: 60 - DNA, 1666 bp, Homo sapiens
gatccctccgctctggggaggcagcgctggcggcggggctggggccactgaggaaatccatccgcgccgccgccgccgccgccgccgccgccgccgcctccgccgcggaggaagacagcgccgcccgcgcaccgccagcgacccccgccgcagagtcccaccgccacaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgtaaaaaaaaaaaaaaaaaa

SEQ ID NO: 61 - DNA, 3308 bp, Homo sapiens
tcccggtagccgcagctgtcttttccggcccccgtgcactctccgcccgagcggagccccccggctcgcggggatcgcccccgagcgctgcgtcctgcgggtcacctaacccatttgtggcttcctctacctgtgctcagccatggccagcgagagctcacctctgctggcctaccggctcctgggggaggagggggttgccctccctgccaatggggccgggggtcctggaggggcgtctgcccggaagctgtccaccttcctgggtgtggtggtgcccactgtcctgtccatgttcagcatagttgtttttctgaggattgggttcgtggtgggtcatgctgggctactgcaggccctggccatgctgctggttgcctacttcatcctggcactcaccgtcctctctgtctgtgccatcgccaccaatggagccgtgcaggggggcggagcctacttcatgatcagccgcacactggggcccgaggtcgggggcagcattgggctcatgttctacctggctaacgtctgtggctgtgccgtctccctcctggggctggtggagtctgtgcttgatgtcttcggggccgatgccacagggcccagtgggctccgggtcctgccccagggctacggctggaacctgctgtatggctccctgctgctgggccttgtgggtggggtctgcaccctgggagccggcctctatgcccgggcctcattcctcacattcctgctggtctctggctccctggcctctgtgctcatcagttttgtggctgtggggccgagggacatccgcttgactcctaggcctggccccaatggctcctccctgccgccccggtttggccacttcaccggcttcaacagcagtaccctgaaggacaacttgggcgctggctatgctgaggactacaccacgggagccgtgatgaattttgccagcgtctttgctgtcctctttaacggctgtacaggcatcatggctggggccaacatgtcaggggagctgaaggaccccagccgggcgatccctctgggcacgatcgtcgccgtcgcctacaccttcttcgtctatgtcctgcttttctttctctccagcttcacttgtgacaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggcgtgatcttggcaccggccaaggttgtgtcccgagggggaaacccctgggcagctgtactttattcttggggcctggtgcagctggtgctcctggctgggaagctgaacacactggctgctgtggtcactgtcttctacctggtggcctatgctgccgtggacctgtcctgcctgagcctggagtgggcctcggcccccaacttccgccccaccttcagcctgttctcctggcacacctgcctgctgggggtggcctcctgcctgctcatgatgttcctcatcagtcctggcgcggctggtggctccctgctcctcatgggtctgctggctgccctgctcaccgcgcgaggaggccccagtagctggggctatgtcagccaggccttgcttttccaccaggtgcgtaagtatctgcttcggctggacgtccggaaggatcacgtgaagttctggcggccccagctgctgctcctggtggggaacccccggggcgccctgcctctgctgcggttggccaaccagcttaagaagggggggctgtatgtgctgggccacgtcaccctgggagacctcgactccctgccctcggaccctgtacagccgcagtatggggcatggctcagcctggtggaccgtgcccaggtgaaggcttttgtggatctaaccctctcaccctccgtgcgccagggggctcagcatctgctgcgaatctccggcctcggtggcatgaagcccaacacgttggtcctaggtttctacgatgacgctccaccgcaggaccatttcctgacggacccggctttctctgagcctgcagacagcaccagggagggcagttccccagctctgagcaccctgttccctcctccccgggctcctgggagcccccgggccctcaatccccaggactatgtggccacggtggccgacgccctcaagatgaacaagaatgtggtgctggcccgggccagcggggccttgccccctgagcggctgagccgggggtctgggggcacctctcagctgcaccatgtggacgtgtggcccctcaacctgctgcggccccggggtgggcccggctatgtggatgtctgcggcctcttcctgctgcagatggcaaccatcttgggcatggtgcccgcttggcatagcgcccggctccggatcttcctgtgcctggggcctcgggaggcgcctggggcggccgaggggcggctgcgggcactgctgagccaactgaggatccgggctgaggtgcaggaggtggtgtggggcgagggggccggggctggggaacccgaggcggaggaggaaggggactttgtgaacagtgggcggggagacgcagaggcagaggccctggcacgcagcgccaacgccctggttcgggcccagcaggggcgcggcacaggaggagggccgggtgggccggagggtggggatgctgagggccccatcacagccctcaccttcctgtacttgcctcggccgccagccgatcccgcccgatacccccgctacctggcgctactggagactctaacccgagacctgggccccacgctgctggttcatggggtcactccagtcacctgcactgatctgtgatgcccctgcctccagggctaggtagagagggcccaggcaggcggcctatcctgatccttggaggaggaggaagaggaggccactgtggcccgtggccctgcccttgggacgtggagcccaggggaggtttgaaggggatcctgggcttgggcatcacgcccacctcctttggcagagggaccccagcacactaactctgggtggctgtccccaccgtgcaggggagggagtccgcagcctcccttcactggtgccttgatgctaggggccaggcctcctctgtgactctgggctacctcagtttccccattttggccagactcaccggcccactggggtggtgatgttttcgttctgttttatttttctaactctgctgaccatgaataaaagaccaaaacactacaaaaaaaaaaaaaag

SEQ ID NO: 62 - DNA, 2843 bp, Homo sapiens
gcttccacatgtgtcaagcggctggctcagcccagagtccctgtctcccgcccgccggcccgagccgccgcccctcccccgcctcccgtgcgcccgggacaatcctcgccttgtctgtggcgccggcatctggagctttctgtagcctccggatacgcctttttttcagggcgtagccccagccaagctgctccccgcggcggccgcacagcagcccgagcgccccctttccggagctcccctccggagctgggatccaggcgcgtagcggagatcccaggatcctgggtgctgtctgggcccgctccccaccatgacctcctcggggcctggaccccggttcctgctgctgctgccgctgctgctgccccctgcggcctcagcctccgaccggccccggggccgagacccggtcaacccagagaagctgctggtgatcactgtggccacagctgaaaccgaggggtacctgcgtttcctgcgctctgcggagttcttcaactacactgtgcggaccctgggcctgggagaggagtggcgagggggtgatgtggctcgaacagttggtggaggacagaaggtccggtggttaaagaaggaaatggagaaatacgctgaccgggaggatatgatcatcatgtttgtggatagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggattcatcggttttgccaccaccatccaccaaatcgtgcgccagtggaagtacaaggatgatgacgacgaccagctgttctacacacggctctacctggacccaggactgagggagaaactcagccttaatctggatcataagtctcggatctttcagaacctcaacggggctttagatgaagtggttttaaagtttgatcggaaccgtgtgcgtatccggaacgtggcctacgacacgctccccattgtggtccatggaaacggtcccactaagctgcagctcaactacctgggaaactacgtccccaatggctggactcctgagggaggctgtggcttctgcaaccaggaccggaggacactcccgggggggcagcctcccccccgggtgtttctggccgtgtttgtggaacagcctactccgtttctgccccgcttcctgcagcggctgctactcctggactatccccccgacagggtcacccttttcctgcacaacaacgaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtgggtgtgtggaatgtaccatacatctcccaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctgacactcaaccactctgccaaacctgccctgccattgtgcctttttagggggcctggcccccgtcctgggagttgggggatgggtctctctgtctccccacttcctgagttcatgttccgcgtgcctgaactgaatatgtcaccttgctcccaagacacggccctctcaggaagctcccggagtccccgcctctctcctccgcccacaggggttcgtgggcacagggcttctggggactccccgcgtgataaattattaatgttccgcagtctcactctgaataaaggacagtttgtaaaaaaaaaaaaaaaaaa

SEQ ID NO: 63 - DNA, 1208 bp, Homo sapiens
ggcggcgacagggagggaggaagcctaggagtccgccgcgggacggaggcctgggggaactgggagttcagctttctgcagagggccactaggaacctcggattgcccacggaagccagccactttctttgacagtccagcccacctcctcttctgcccggagaagctccaggggctgcctttgtgatcacagcatcttcacaaggaccaaaggaaaataagatttcttgtaagaacaccgtgaccacatctttaaaatgacccatttcgtggctcccacaagatttacacctccacactgaggccggaagtggttttgcccctataaaacatggcgaaaagctttcttgtctccaaggaaacgccacgtaatgagtcaaagctgtggcgcacgcgcagaagtacaagctaccggaagtgatggcgcccctactaaagccttggggttagtacgcgtgcgcagcagtttcttccgacagttgtgttgtgccaatggtggagaagaaaacttcggttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccggaaaaaaaaaaaaaaaaaaaaa

SEQ ID NO: 64 - DNA, 735 bp, Homo sapiens
agtggttctccgcccctgccactgggccatggagactgtggcacagtagactgtagtgtgaggctcgcgggggcagtggccatggaggccgtgctgaacgagctggtgtctgtggaggacctgctgaagtttgaaaagaaatttcagtctgagaaggcagcaggctcggtgtccaagagcacgcagtttgagtacgcctggtgcctggtgcggacaaggtacaatgatgacatccgtaaaggcatcgtgctgctcgaggagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaaa

SEQ ID NO: 65 - DNA, 681 bp, Homo sapiens
atgttgcttaggctggtctcaaactcctggcctcaagtgatcctccctcctcggcctcccaaagtgctgggattacaggcaccgagaagagctcggaaaagagcagaaggcaccgccagctccaacgtcttctccatgtttgatcagtcccagatccaggagtttaaagagagtctggctctgtcgcccaggctggagcgcaatggcatgatctcggctcactgcaacctctgcctcacgggttcaagcaattctcctgcctcagcctcccaagctttcaccatcatggaccagaaccgtgatggcttcatcgacaaagaggacttgagggacacctttgccgcgctgggccgcatcaatgtcaagaacgaggaactggaggccatggtgaaggaggcccccggacccatcaacttcacggtgttcctgaccatgtttggggagaagctgaagggcacggacccagaggagaccattctccacgccttcaaagtgttcgacactgaagggaaaggtttcgtcaaggccgatgtcatcaaagaaaaacttatgacccaggcagaccgcttcagtgaggaggaggtcaagcagatgtttgcagcgtttcccccagatgtgtgcggcaacctggactacagaaacctgtgctacgtcatcactcacggtgaagagaaggattag

SEQ ID NO: 66 - DNA, 2527 bp, Homo sapiens
gcgccccggccgggccactgggccacaggccacgcggccacgcagtccgagcgggagccgagccgggcggggcgagggcagctccgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgccacaaccgcgagatcgaggagctccacaagctcaaggtccagctggacgggcatgagcgcagcctgcaggtcttgtgaggggccgagggccggggctgggagcggccctgtgcccgggagtccgcagaggcggggatttgtcagatgcagacattttgcaaggctgccgggtagttcaagaccaaagttttcctcttgtcttaataccataaggactggatgacttctcctgagatagaaccgtttggttcaatgagggactgtgttgctaagagcgttgggggcaaagccaggctggttccttggcctcggggtttcctgggtcggggacacggtgaagaggctccagcgggacctgcccatcagtcctgggccaggaggggctccaagcagcacccagcggtccgggggagtctcagacccggcatgcgtggctggcagacctgggagagccagggcagggttttgcgttcagagaaggattgccccagagacccgtggtggacttcatgggtgctgagtggcccgtgtgacagtgatgacacgaaggcttcggcgtttgagtgggtgcaggtgcacgccagggcttggtgcttccctgcctggccctggagggagctgggtggcctggcttcaggggaagacaggagccaggactcacgtcagcccagcaggtgtggggggtgctgcagccctcggcagtggggtcaggccctgggggatgtttccaatggtgggcagcctggccaggccggagaagacatgttcacgggcatctatcagatgcccccttgaggaggctgagttatttgagggctgctgcaaagtacgctaggctcaaattctcttttcccagccagagccctggccacacggactcagaggggccaccggggtggggaaaggacccctccccgacccccgcagccactggcctccagctctcggccacagaatggcctctaaggctgactcagccgctcccttgggctgtggcagcaggaggcgggggctctggctcaggccccggagcctgtgcagcttgcccatggccctaggcagcgaggggacagcctgggggacttcctgcctaggcaaggtcattggccgggcctggcctgtggatagtggggccaggggccggcccaggccaaatgagtgccctccttgttatgacaccaagtgactacaagggaggcaagacccctccaggcctcccagccgacactgggtcccaccacacacagtgactgtgccgtgcagtgcaggttctggccttttccttgaaggcatctggtaaacccgaagccacgctctcgggccgcacatgcacgccgcagcaccagctgccctgagctgcttgtacaaccaaacacctttcccctcttctccagctgtaacctggagagtcagccatgccttgtcttttgttctcatgaatagtcactggggccgggcgcagtgactcacgcctgtaatcccagcactttgggaggcctaggtgggcggatcacttgaggtcaggagttcgagaccagcctggccaacatggtgaaaccctgtctctactaaaaaaatacagaaaattagctgggcgtggtggcgggcgcctgtagccccagctacttgggaggctgaggcgggagaatggcaatggcgtgaacccgggaggcagagcttgcagtgagctgagatggcgccactgcactccagcctgggcgacagagccagactcaatctc

SEQ ID NO: 67 - DNA, 918 bp, Homo sapiens
ggggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagtatacatggcctggtcctaccagagactcacccaatgccagcctccagccagggagagccaagtttgcattttcacacgcatctcacactcctctgcactctcaacttggagagctccaaacagggaaaccccaagccttgctggcttctgccaaccccctgagcagaagcatgggtccccctgatcaccacctcaccaccctcatcctgatctcactgtacactccctttcctggtctgctaagtagcgggtgttttccttgacactaacgctacagctagaccacggtgggcttggcaacaggtgtcttcccagatgctggcgttaccgctagaccaaggagccctctggtggccccgtccgggcataacagaaagctcgcactcttgtcttctggtcactcctcactgtccccttcagcctcctatctctgtatggcctggtgtttcctaggttatgattgtagagcgaggattattataatattggaataaagaataattactacaaactaatgattaatgattcatatataatcatatctaagatctatatctagtataactattcttattttatatattttattatactggaacagctcgtgccctcggtctcttgcctcggcacctgggtggcttgctgcccacatccaccaagtgcactttgggaggctgaggctggaggactgctggaggccaggagttcaataccagcctgggcaacatagggagaccccccccccaccatctcc

SEQ ID NO: 68 - DNA, 596 bp, Homo sapiens
gtggcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcgggtggccataaaagacaagcaggaaggaattgagtaggggccagagggggctctgctcggcctgtgagccccgttcctacctgtgcctgaccctccgctccaggtaccacaccgaggagagcggccggtcccagccatggcccgccttgtggccacccctcaccctgacaccgacgtgtcctgtacatagattaggttttatattcctaataaagtatagcgggagaga

SEQ ID NO: 69 - DNA, 397 bp, Homo sapiens
cggcggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctga

SEQ ID NO: 70 - DNA, 572 bp, Homo sapiens
cggcggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctga

SEQ ID NO: 71 - DNA, 793 bp, Homo sapiens
cggcggtggcggacacttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccgggtgagggcggggcctggaggggcagacggggtgggctggacactggcccgtgtgcccaggcctgggacagccctggcctgtttcttcggaggtcctcagggagaggcggcggtgatggaagaacagggacttccaccacaggctccaggacatgtggactgaggggctgtggagtctgggcctgtggctcccgtctgccccatgggacttctgtagtgctgcagggtccctcgggtgctgtgggccagatccgggcggggacctactgtcctttgggggtgctcttctacgtcccttgtcggtgattggcaaggcctggtccttccaggcctctgggaggcagctcaccccagggtggcccacacctgttcctagcagggcgcctgggaatctagaacagtttagaggggaaagagccacagcaaagaaaag

SEQ ID NO: 72 - DNA, 397 bp, Homo sapiens; identical to SEQ ID NO: 69

SEQ ID NO: 73 - DNA, 572 bp, Homo sapiens; identical to SEQ ID NO: 70

SEQ ID NO: 74 - DNA, 793 bp, Homo sapiens; identical to SEQ ID NO: 71

SEQ ID NO: 75 - DNA, 1530 bp, Homo sapiens
actcaatgtcggaacgttccgaagatgacgtcggagcgttctcgaatcccgtgtctctcggctgctgctgccgaaggaacagggaaaaagcaacaagaaggaagagcaatggcgacactggatcgcaaagtgcccagtccggaggcgtttctgggcaaaccctggtcctcctggatcgacgccgccaaattacactgctccgacaatgtagatttagaagaggctggaaaagagggtggaaaaagcagggaggttatgaggcttaataaagaagatatgcacttatttggccattacccagcacatgacgacttctatctcgtagtgtgcagtgcctgtaaccaggtcgtcaagccacaggttttccagtcgcactgcgggagaaagcaagacaacaggagaaatgaaggcatctccaggagtggaccagagagcagccaagccatagagaagcatcaggtgtgagaatggaaaacgcagaagagacgtacaacttctgaaagatctcagaggactggcattgtctggagacggcttcctggaagaggagactccagcagagccctgaagtgtggacaagcttccattcactgcaaattcgtgagcacactctggtgtcaggatctagtaaggaaatgggcttgagcagagcagggggtacctgtggggttcttctcttcattttcaccaccacaaagctggtctaagctgccatcaattcccacctggacaactgcaaaagccttccagctgttcctgcttccactcttgctcctctacaattcattctgcacgcagaagtcagaatcaaaatcaaagttcatcatgtcattctcttgacttgtggcttccctttgctcttaagctaaaagtaaaaatcattatcatggctacaaagtcttgtgtggtctgggccacatcctgtgccaggctccctttcattgtctatattccagtcaagctggccttcaaaatttcagcacattgggtctttctgccacaggcccttgcacatacatgcttttccctctgtacatgtgattttctttcatccccgctttccaaagctaactctgactcatccttcagactgcatcttaatgattacttccttctggaagactcccctaattttcacaactagatgagctctcccttatatgttgaaaacaagtatttcttgtgtgaacagaaatgtttaatgtctgccttcccaactcagccacaagctctgtgaggatggggactcagtctttgcatccctcagagcctagcatagtctcagttaatacgtgatagctggagcgtgacatttcattaggaacagtgaggctagttgagaaattatacctcaccagtatataggagagtaccattaggaattcttaatgggatgaaaacctgaattcatgtctagaccctgccacctgctggctgtgctgttttaaataaattgcagatcctctcagaaaaaaaaaaaaaaaaaaaaaaaaaaaaaaaaaaaaaaaaaaaagaaaaaaaaaaaaaaaa

SEQ ID NO: 76 - DNA, 2183 bp, Homo sapiens
gagcgcacgcgtacacgcgtgcgcaggggaagaccgagtgccaggggctgaaccgcagggaagggggcgcggcgcacgcagtatggcgcccaacatctacttggttcgccagcggatcagtcgactcggccagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaaaaaaaaaaaaaaaaaaaaaaa

SEQ ID NO: 77 - DNA, 2149 bp, Homo sapiens
gcgccagccccgcctgcccttcctcgccaccgggctgctctggtctcgtcggtcccctcctccgccccgtcgtcctgactctctctccctcctttcctcagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaaaaaaaaaaaaaaaaaaaaa

SEQ ID NO: 78 - DNA, 4930 bp, Homo sapiens
ctcagccttcccggttcgggaaaggggaagaatgcaggaggggtaggatttctttcctgataggatcggttgggaaagaccgcagcctgtgtgtgtctttcccttcgaccaaggtgtctgttgctccgtaaataaaacgtcccactgccttctgagagcgctataaaggcagcggaagggtagtccgcggggcattccgggcggggcgcgagcagagacaggtcatggcagcgccaggcggcaggtcggagccgccgcagctccccgagtacagctgcagctacatggtgtcgcggccggtctacagcgagctcgctttccagcaacagcacgagcggcgcctgcaggagcgcaagacgctgcgggagagcctggccaagtgctgcagttgttcaagaaagagagcctttggtgtgctaaagactcttgtgcccatcttggagtggctccccaaataccgagtcaaggaatggctgcttagtgacgtcatttcgggagttagtactgggctagtggccacgctgcaagggatggcatatgccctactagctgcagttcctgtcggatatggtctctactctgcttttttccctatcctgacatactttatctttggaacatcaagacatatctcagttggaccttttccagtggtgagtttaatggtgggatctgttgttctgagcatggcccccgacgaacactttctcgtatccagcagcaatggaactgtattaaatactactatgatagacactgcagctagagatacagctagagtcctgattgccagtgccctgactctgctggttggaattatacagttgatatttggtggcttgcagattggattcatagtgaggtacttggcagatcctttggttggtggcttcacaacagctgctgccttccaagtgctggtctcacagctaaagattgtcctcaatgtttcaaccaaaaactacaatggagttctctctattatctatacgctggttgagatttttcaaaatattggtgataccaatcttgctgatttcactgctggattgctcaccattgtcgtctgtatggcagttaaggaattaaatgatcggtttagacacaaaatcccagtccctattcctatagaagtaattgtgacgataattgctactgccatttcatatggagccaacctggaaaaaaattacaatgctggcattgttaaatccatcccaagggggtttttgcctcctgaacttccacctgtgagcttgttctcggagatgctggctgcatcattttccatcgctgtggtggcttatgctattgcagtgtcagtaggaaaagtatatgccaccaagtatgattacaccatcgatgggaaccaggaattcattgcctttgggatcagcaacatcttctcaggattcttctcttgttttgtggccaccactgctctttcccgcacggccgtccaggagagcactggaggaaagacacaggttgctggcatcatctctgctgcgattgtgatgatcgccattcttgccctggggaagcttctggaacccttgcagaagtcggtcttggcagctgttgtaattgccaacctgaaagggatgtttatgcagctgtgtgacattcctcgtctgtggagacagaataagattgatgctgttatctgggtgtttacgtgtatagtgtccatcattctggggctggatctcggtttactagctggccttatatttggactgttgactgtggtcctgagagttcagtttccttcttggaatggccttggaagcatccctagcacagatatctacaaaagtaccaagaattacaaaaacattgaagaacctcaaggagtgaagattcttagattttccagtcctattttctatggcaatgtcgatggttttaaaaaatgtatcaagtccacagttggatttgatgccattagagtatataataagaggctgaaagcgctgaggaaaatacagaaactaataaaaagtggacaattaagagcaacaaagaatggcatcataagtgatgctgtttcaacaaataatgcttttgagcctgatgaggatattgaagatctggaggaacttgatatcccaaccaaggaaatagagattcaagtggattggaactctgagcttccagtcaaagtgaacgttcccaaagtgccaatccatagccttgtgcttgactgtggagctatatctttcctggacgttgttggagtgagatcactgcgggtgattgtcaaagaattccaaagaattgatgtgaatgtgtattttgcatcacttcaagattatgtgatagaaaagctggagcaatgcgggttctttgacgacaacattagaaaggacacattctttttgacggtccatgatgctatactctatctacagaaccaagtgaaatctcaagagggtcaaggttccattttagaaacgatcactctcattcaggattgtaaagatacccttgaattaatagaaacagagctgacggaagaagaacttgatgtccaggatgaggctatgcgtacacttgcatcctgaaagtgggttcgggaggtctctatgagcaaggaatacaagacaaaacttcctcaatgcattgactatttcttcagactcaaaacactcattcttttttctattaagccattgaaagagaagcactaagactgcttctaggctttatttataaaataaacaccttatccctaacatgggcaaaatggctagaattattcagacgatttggcagcgtccagggtaagctggtgttataatacgctgctgatctacatcacagatttgctaataatgttcacgtgggccctggcatatctctgttcagttagagtgagtgctgacccaacagcctctgtggtcaagcgagtcacgaatgattaatcataaagaaaaatcagtttttgactgacctggatatccatgagctgcactgatcaccatgtaaggtcacatttagtaaatgctgaaataaaatgattaatgcatttatcaataaaagcctttgaaaatactttggataataaattggagttttaaaaatgcaaatttgcttagtatctaataatgaagtgttattacatatagccggaattgaggatctctttgatcctggaaatggtttacctaaaagctacagaaccaggccaatatattttgaaatattgatgcagacaaatgaaataataaagagattttcatggtttataaaaatcttttttgatatgataataatcatgatcacaactgagatcaaaaaaatatatgacagattattttgtttaaaaatgcagttttaattatcttagtctatagaaatgatcattgcatggaggcatgtataggtatgatctgtgtaaaatctgacataaaaacagtgctattctgagtgaaaatttttttgatgtgcttacataaccatggtgattaaaatgagtttatattttttctcaaaaattttagcagtgtgtaaagtaagtaatctttaactgaactctgaccacttaaaaaaaaatctaaaaattgaactacctatagtagtctgtgtttaaagtgaatttttaaagacaaagcattctaaatgaactcaatataaaaacattcatttggaatgtacatactgaaaaatacaggtttttttgaccaaaagtttttatatcttttctttttatttatttttttcctaagtgccaacaattttctagatattatatacaacacaggctttgatcttggggacttttcccatatatttcacactggagtgaatgaagttgtacttcatttctagagaaaagttatacccaggtccccaattgagaatgtcttgcttgattgaaaacgacatcatcccttggtatactccagggattggtttcaggacccctgcatttaccaaaatttgtgcacactcaagtcctgcagtcacccctgcctaaagatagaatggcttctctgtttttcttctgaaatacaaccagaaacaatgtgtctatttctgaaagaataggattaatgatcatacaaatgggttaatcctgaattctggttgtaaatctggttacagcataactaggattataatgctgcctcattttcacagcactacttgcttatattgacaacaaatcatctcgctaaagagtgaatgtaggccaggcgcggtggctcatgcctgtaatcccagcactttgggaggccgaggcgggtggatcacgaggtcaggagatcgagaccatcctggctaacatggtaaaaccccgtctctactaaaaatagaaaaaaagaaattagcctagcgtggtggctggcgggcgcctgtagtcccagctatttgggaggctaaggcaggagaatggcgtgaacccgggaggcggagcttgcagtgagccgaggtcgtgccactgcactccagcctgggcgacagagcaagactccgtctcaaaaaaaaaaaaaaaaaaaaaaaaagagtgaatgtaatagtcttgcagaaaatgaatgaatacctttgttcaataaaggaaatatgcactgctcacttttttgaaggaaatgccaaagttacgttttacaacaaggctagagtttgtaaattctgggttcatttgtgatgacataagtcagcaaactgcgggaatactgtctcttctatgtattttgtgaatagtaagcataattttagttttgtattatcaatgaaaatttcacttgaaattaaagctgccttttgttatatttttaacctataggataagattccagtattgtatatgagttttaacaaattaaaaaatcaaatcatgtacatttgaaaatatttgcacacatttaaaaataaatgtaaagttgtcttttaaactactcggatgtgtcctttctgaacaaaa

SEQ ID NO: 79 - DNA, 1978 bp, Homo sapiens
cactgtgctctgcgagccgaatcatggatcacactgacaatgagttacaaggcactaatagttctggatccttgggtggtcttgatgttcgcagacgaattcctataaagctcatctccaaacaagcaaacaaagcgaaacctgcaccgcgaactcaaagaactataaacaggatgcctgcaaaggctccacctggtgatgaagaaggatttgattataatgaagaagaacggtatgactgtaaagggggtgagctgtttgcaaatcagcgaagatttcctggacaccttttttgggactttcagataaacatcttaggtgaaaaggatgatacaccagttcatttctgtgacaagtgtggattgcctattaaaatctatgggagaatgattccatgcaagcatgttttttgctatgactgtgctattttacatgaaaaaaagggagataagatgtgtccaggctgtagtgatcctgtgcagcgaattgagcagtgtacacgaggttctctcttcatgtgtagcattgttcaagggtgcaagagaacatatttgtctcagagagacttacaggctcatatcaaccatcgccatatgagagctggaaaacctgttacccgtgcttcacttgaaaatgttcatcctcctattgccccaccaccaactgaaatccctgagcgttttataatgccaccagacaagcaccatatgagccatattccgccaaagcagcatatcatgatgccaccacctcctttgcaacatgtgccacatgagcactataatcagccacatgaggatattcgtgctcctccagcagaattgtccatggctccacctccacctcgatcggtcagtcaggaaacctttcgtatttcaacaagaaaacacagcaatttaataaccgtccctattcaggatgactcaaattcaggtgctagagaaccaccacctcctgccccagcacctgctcaccatcatcctgaatatcagggtcaaccagtggtatcgcaccctcatcatattatgcctccacagcaacattatgcaccacccccacctcctccaccaccaataagccatccaatgccacatcctccccaggctgcaggtactcctcacttggtatatagccaagctccacctccaccaatgacctctgctccaccaccaataacccctccccctggacatattattgcccagatgccaccttatatgaatcatcctcctccaggacctcccccgcctcaacatggtggtccacctgtaactgcaccccctcctcaccattataatcctaactcattaccccagttcactgaagatcaaggaactccgagccctccatttacacaaccagggggaatgagtcctggtatatggcctgcaccaagagggccaccaccacctccacgattgcagggtccgccttctcaaaccccacttcctggaccacatcatccagatcagacaagatatagaccgtattaccaatgataatagtattttgaatggaagatatgagggggaaaaaaacttatgtgtagtcaatcttttaagctttgactgttttgggaaggaagagtacctcttatcgaggtagtataaaacacatagggtcttgtttcttaaaatggttttaaatcttgaccttaagattgatttcaagtaccatactgtagtacagataagtggctcagttgagcacagctatattttaacatctctttgttcccctagtttagtaaattgacccagaggtgaccatttgtaaaaaatttgaaaaaatttttcattgttttacttcagaagtattgttttgttaaacccaacgtttagtttttcttgtgatacattttgttaacctgtgtaaaaggattaaatttcaatatggttgtaaaaaaaaaaaaaaaaaaaaaaaaaaaaaaaaaaaaaaaaaaaaaaaaaaaaaaaaaaaaaaaaaaaaaaaaaaaaaa

SEQ ID NO: 80 - DNA, 2320 bp, Homo sapiens
gcgcagggaggggagaccttggcggacggcggagccccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaacagattttgcatctagaggaattgaaatgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcctagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatatatttttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatatgtaagacaaaaaggactacttattgtagtcatcctggaatatctccgtcaactcatattttcatgctgttcatgaaagattcaatgcccctgaatttaaatagctcttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccaaactgatgtaagtaaatggtctctcacttgttttatttaacctctaaattctttcattttaggggtagcatttgtgttgaagaggttttaaagcttccattgttgtctgcaactctgaagggtaattatatagttacccaaattaagagagtctatttacggaactcaaatacgtgggcattcaaatgtattacagtggggaatgaagatactgaaataaacgtcttaaatattc

SEQ ID NO: 81 - DNA, 5901 bp, Homo sapiens
atgtggatacctacggagcacgagaaatacggcgtggttattgccagtttccgaggaaccgttccatatggcctgtcattggaaattggagatacagttcagatcctggagaagtgtgatggctggtacagaggatttgccttaaaaaacccaaatatcaagggtatatttccttccagctacgttcacttgaaaaatgcctgtgtaaagaacaaaggacaatttgaaatggttattcccactgaagactctgttatcacagaaatgacatcaacattaagagactggggaaccatgtggaaacaactctatgtgcgtaatgaaggcgatctcttccaccggctgtggcacatcatgaatgaaatcctggacctgaggcggcaggtgctggtgggccacctcacccacgaccggatgaaggacgtgaagcgccacattactgcccggcttgactggggcaatgaacaactgggactggacctggtgcctaggaaagagtacgcaatggtggatccggaagacatcagcattactgagctctaccgattgatggaacatcgacatcggaagaaagacaccccggtgcaggccagcagtcaccacctctttgtccagatgaagagcctcatgtgttccaacctgggagaggagctggaggtcatcttctcactctttgacagtaaagagaaccggccaatcagtgagagatttttcttgaggctgaatagaaacgggcttcccaaagcccctgataaaccggaacgacattgctccctctttgtggatttgggcagcagtgagctaagaaaggacatttatatcaccgtgcacattatccgaatcggtcgaatgggagcaggagaaaaaaagaatgcctgtagtgtccagtaccgacgaccctttggctgtgcagttcttagcatcgctgacctgctaacaggagagacaaaggatgacctcattctgaaagtatacatgtgtaacacagagagtgagtggtaccaaatccatgagaacatcatcaaaaagctgaatgcacgttataacttgactggctccaatgcaggtttagcagtttccttacagctattgcacggagacattgaacaaatcagaagggaatattcatcagtattttctcatggagtatccataacaaggaagctgggattttcaaatattattatgcctggtgaaatgaggaatgatttatatatcactattgaaaggggagaatttgagaaaggagggaagagcgtggccagaaatgtggaagttacgatgttcattgtagacagtagtggccaaaccctgaaggattttatctccttcggctctggggagccaccagccagtgagtaccactcctttgtgctttaccataacaacagtcccaggtggtctgaactgctgaaacttcccattcctgtggataaattccggggtgcacacatccgcttcgagtttcggcattgttccacaaaggagaaaggagagaagaagttgtttgggttttcttttgtccctctgatgcaagaagatggtaggactcttccagatggcactcatgagctcatcgtgcataagtgtgaagaaaacacaaatcttcaggatactacccgctacctcaaacttcccttttccaagggcattttccttgggaataataatcaagccatgaaggccacaaaggagtccttttgtattacatcttttctctgttccacaaaactcacacaaaatggtgatatgcttgatcttttgaaatggagaacccacccagacaagatcactggctgtctctctaaattaaaagaaattgatggctcagagatagtaaagtttctgcaggatacactggataccttatttggaattttagatgaaaattcccaaaaatatgggtctaaagtgtttgattctttggttcacataataaatttgctgcaagatagcaaatttcatcattttaaacctgtaatggacacttacattgagagtcattttgctggggcacttgcatacagagatctcatcaaagtgctcaaatggtacgtggaccggatcacagaagcagagcggcaagagcatatccaggaggtgctgaaggcacaagaatacatttttaagtatatagttcaatctcgaaggctgttttcccttgccactggtgggcaaaacgaagaggagttccgctgctgcattcaggagcttctcatgtcagtccgtttctttctttcgcaagagagcaaagggtctggagcattatctcagtcacaggctgtgtttctgagctctttccctgccgtgtactcagaactgttgaagctctttgatgtccgggaagtagccaacttggtccaggacaccctgggcagtctgccgaccatcctgcatgtggatgattccctgcaggccatcaaactgcagtgcattggcaaaaccgtggaaagccagctttataccaacccagattcccgatacattcttctgcctgtcgtgttacatcacctccacattcacttgcaagaacagaaggacctgatcatgtgtgcacgtatccttagcaacgtattttgtcttatcaagaaaaatagctcagaaaaatctgtgctggaggaaatagatgtgatagtggccagcttgctggatattctgctgaggaccatattggagatcaccagccgacctcagccatccagctcagcaatgcggttccagttccaggatgtcactggggagtttgttgcttgtctcctgtccctattacgacaaatgacagatagacattatcaacagcttcttgatagttttaatacaaaggaagaactaagggatttcctgctgcagatatttactgtgttccgaatattgatacgcccggagatgtttccaaaggactggactgttatgcgcttggttgctaacaatgttattattacaacagttctatacctctcagatgcacttcgtaagaacttcttaaatgaaaactttgattataagatctgggattcctacttttacctcgcagtcatttttataaaccagttgtgtctgcagttggagatgttcacaccttccaagaagaaaaaggtgttagaaaagtatggtgacatgcgggtaacaatgggttgtgaaattttcagcatgtggcaaaacctaggagagcacaagcttcattttatccctgccctgattggccccttcctagaagtgaccttgataccccagccaggtcttcggaatgtcatgattccaatttttcatgatatgatggactgggagcagaggcggagtggcaactttaaacaggtggaagccaagctaattgacaaactggatagcctgatgtcagaaggcaaaggtgacgaaacataccgcgagctcttcaacagtattctactaaagaaaattgagcgggaaacatggcgggaaagtggcgtttcattaattgctactgtaactcgtctaatggagaggttgttagattacagggactgcatgaaaatgggagaggtagatggcaaaaagattggctgcacagttagccttctgaacttctataagactgaactgaacaaggaggagatgtatatacgctacattcacaaactctatgatctgcatctcaaagcacagaactttacagaagctgcatataccctcctcttatatgacgagctactggaatggtctgatcggcccctcagggagttcctgacctaccccatgcaaacagaatggcagcgcaaagagcacctgcacctcaccatcatccagaactttgacagaggcaaatgttgggagaatggcattatcttgtgccggaagattgcagagcagtatgagagttattatgactacagaaacctgagcaagatgcggatgatggaagcctctttgtatgacaaaattatggaccagcaacgtcttgaaccagagttcttcagagttggattttatggaaaaaaatttccatttttcttaagaaataaggagtttgtgtgtcgagggcatgactacgagaggctggaagccttccaacagagaatgctgaacgagttcccccatgccatcgccatgcagcacgccaaccagcccgatgagaccatcttccaggcagaagctcagtatttgcagatatatgctgtgactcccattccagagagccaggaggtcctgcagagagagggtgttccggacaacatcaaaagcttctataaagtgaatcacatctggaaattccgctatgaccgaccatttcacaaaggcacaaaagataaagagaatgaattcaagagtctctgggtggagagaacgtcattatacttggtgcagagtttgcctggcatctctcgctggtttgaagtggaaaagcgtgaagtggtagaaatgagtcctctggaaaatgcaattgaagtgctagaaaataagaatcagcagctgaagactctgattagtcagtgtcagacaagacagatgcagaatattaatcccctgactatgtgcctgaatggagttatagatgctgcagttaatggtggcgtttccaggtatcaagaggcattctttgtcaaagaatatatcttaagtcaccctgaagatggggagaaaattgcacgattaagagagctgatgcttgagcaggcacagattctggaatttggtttggccgtgcatgagaagtttgtacctcaagatatgagaccccttcacaaaaagctggttgaccaattctttgtgatgaagtcgagcttagggatacaggagttctctgcttgtatgcaagccagtcctgtccattttcctaatggaagccctcgtgtgtgtagaaactcagcacctgcttctgtgagcccagatggtaccagggtaattcctagacgcagcccgttaagttacccagctgtcaaccgatattcttcctcctcactgtcctcacaagcttctgctgaagtaagcaatattacagggcaatcagaaagctctgatgaagtctttaacatgcagccaagtccatctacctcaagcttgagttctactcactcggcttcacctaatgtgacaagttctgctccatcgagtgccagagcttctcctttgttgtctgacaaacacaaacattcccgagaaaactcttgcctgtcaccaagagagagaccatgcagtgccatctatccaacacctgtggagccttcgcagaggatgctgtttaatcatattggagacggggccttgccacgcagtgacccaaatctctctgcacctgaaaaagctgtgaaccccacccctagcagctggagcctggacagtgggaaggaagccaagaacatgtcggatagtgggaaacttatctctccccctgtccctccaagacccacacagactgcttcaccagcaagacacacgacatcagtatccccctcgcctgccgggcgatctccattgaagggctctgtgcagtctttcaccccctctccagtggagtaccactcgccaggactcatctccaactcccctgtcttgtcgggcagctacagcagtgggatttcttctctcagccggtgcagcacgtcggaaacctcaggctttgaaaatcaggtgaatgaacagtcggcccccctgccggtgccagtgccggtgcccgtgccgagctacggcggggaggagccagtgcgcaaggagagcaagactccgcccccgtacagcgtctacgagcggactctgcggcgccccgtcccgctacctcacagcctctccatccccgtcacgtcggagccgcccgcgctgccccccaagcctctggcagcgcgatccagccacctggagaatggggcccggaggactgaccccggcccgcggcccaggcccctgccccgcaaggtctctcagttataa

SEQ ID NO: 82 - DNA, 5680 bp, Homo sapiens
gggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggaggggcccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggtagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccccaacctaaaaccaaccaccagcatttcactacaggaccaaatggaaaccgagggaaccctgggtcttgggaagaacaacaggaaaccaaggtctgacctagggttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttccacatatgctggctgctgtttacacaccctgccaatgccttagcactggagagctttttgcaatatgctggggaaaggggagggagggaatgaaagtgccaaagaaaacatgtttttaagaactcgggttttatacaatagaatgttttctagcagatgcctcttgttttaatatattaaaattttgcaaagccctttgagctacaaaaaaaaaaaaaaaaaaaaaaaaaaaaaaa

SEQ ID NO: 83 - DNA, 5680 bp, Homo sapiens; identical to SEQ ID NO: 82

SEQ ID NO: 84 - DNA, 1978 bp, Homo sapiens
cgggggtgcaaccctttgaagtgtcccctcctacttcttgctgcctcacggttgctgttgcagacccaggagtctctgaaggcttccgcggctttggggccggttgtgagatgccaggcagaggccgctgcccggactgcggctccacggagctggtggaagactcgcactattcgcagagccagctggtgtgctccgactgcggctgcgtggtcaccgagggggtccttaccactaccttcagcgacgagggcaatctccgagaggtaacatattcccgaagcacaggggaaaacgaacaagttagtcgcagccagcaacgaggtctccggcgagtgagagacctttgtcgagttctgcagttgccaccaacatttgaggataccgcggttgcctactaccaacaggcatatcggcactctggcatccgagcggccaggctgcaaaagaaggaggtgttggttgggtgctgcgtcttaatcacctgccgacagcataactggcccctaacaatgggggccatctgcacgctgttgtatgcagatttggatgtgttttctagcacttacatgcagatagtgaagctcctgggactggatgtgccatctctgtgcttggcagaactggtgaagacctattgcagcagcttcaaactgttccaagcttcaccttctgtgccagccaaatacgtggaagacaaagagaagatgctgtctcgaacaatgcagttggtggagctggcaaatgagacgtggctggtgaccgggaggcatcccttgcccgtcatcactgctgcgactttcctggcttggcagtcgctgcagcctgcagatcggctttcatgttcccttgcccgattttgtaaattggcaaatgtggacctgccctacccggcgtcctcccgcctgcaggagctgctggctgtgctgctgcggatggctgagcagctggcctggttacgagttctgagacttgacaaacggtctgtggtgaagcacatcggtgaccttctccagcaccgccagtcactggtccgctctgcctttcgggatgggacagcagaagtggagacccgagagaaggagccaccggggtggggacaggggcaaggagaaggggaggtgggaaataattccttaggtttaccccaggggaagcggccggccagtcctgcccttctcttgccaccctgcatgttgaagtccccgaagcggatctgccctgtaccccctgtctccactgtcactggagatgagaacatttctgatagtgaaatagaacagtatttgcgtacccctcaggaagttagggactttcagagagcccaggctgctagacaggctgccacgagtgtccctaaccctccctgatggatatccactgggagcacttcatcctgttctgacagcttgataacattcctgttataaccaaggatggaagtgtacaccagtccgtaggtattgcttttcttgtttgaaggaaccaagaggggctctgccattagttggaccctgggtcctggagtaaagtcaggagtgcagggatgactataggtaggagagattcccatcccttggtgtgggagagcaagttgcctatgtccatgttctgtgagatggctttcctcatagatggatgggaaaatgtcaggctctttgctgctggtttgaattggacacactgctgcggctcctcctgcaggcctgagggggcttccctctgcttgtggagtggttggcattcccagcagtatcaaccctcagaggagcgggaactggggaattctggccctacgtgcattcacaggcaatgatgggtttgtgtgtatggtgtcatgagatcctctacctcataacaaaaggacagtgggtagactaaggcagtagctcaaagggctttgcaaaattttaatatattaaaacaagaggcatctgctagaaaacattctattgtataaaacccgagttcttaaaaa

SEQ ID NO: 85 - DNA, 2381 bp, Homo sapiens
ggtgatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcggggaggcaaacttggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagtcccgaacacaggatgaacatccgaagacaatgttctccaaagataaggatattataccatttattgataaatactgggagtgcatgacaaccagacacagacctgggaaaacgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcaagcccctgaccccgagaagctggaaattgactgctgggcagggaaacctatttctggagacctttacagagcctgcttgtatgaacgggttttgttagccctacatgatcgagctccccagttaaagatctcagatgaccggctgactgtggttggagagaagggctactctatggtgagggcctctcatggagtacggaagggtgcctggtattttgaaatcactgtggatgagatgccaccagataccgctgccagactgggttggtcccagcccctaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggctttgataaaattcaagagttatttgtattttgaggaaaaagactttgtggataaagcagagaagagcctgaagcagactccccatagtgagataatattttataaaaatggtgtcaatcaaggtgtggcttacaaagatatttttgagggggtttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctaaaaaaaaaaaaaaaaaaaaa

SEQ ID NO: 86 - DNA, 935 bp, Homo sapiens
gaagtgggtaagggtaatatggaggagcttccggcaggccccggcggctgaaagccggggcagaagtgctggtctcggtcgggattccgggcttggtcccaccgaggcggcgactgcggtaggagggaagaggttttggacgcgctggcctcccgccgctgtgcattgcagcattatttcagttcaaaatgaactatatgcctggcaccgccagcctcatcgaggacattgacaaaaagcacttggttctgcttcgagatggaaggacacttataggctttttaagaagcattgatcaatttgcaaacttagtgctacatcagactgtggagcgtattcatgtgggcaaaaaatacggtgatattcctcgagggatttttgtggtcagaggagaaaatgtggtcctactaggagaaatagacttggaaaaggagagtgacacacccctccagcaagtatccattgaagaaattctagaagaacaaagggtggaacagcagaccaagctggaagcagagaagttgaaagtgcaggccctgaaggaccgaggtctttccattcctcgagcagatactcttgatgagtactaatcttttgcccagaggctgttggctcttgaagagtaggggctgtcactgagtgaaagtgacatcctggccacctcacgcatttgatcacagactgtagagttttgaaaagtcacttttatttttaattattttacatatgcaacatgaagaaatcgtgtaggtgggttttttttttaataacaaaatcactgtttaaagaaacagtggcatagactccttcacacatcactgtggcaccagcaactacttctttatattgttcttcatatcccaaattagagtttacagggacagtcttcatttacttgtaaataaaatatgaatctcaaaaaaaaaaaaaaaaaa

SEQ ID NO: 87 - DNA, 2182 bp, Homo sapiens
aggtaagaggaaactccattggataaatggcgaggaaacgtatactccctcttaaggaacacggtgtcttccttcgtctccgggttcccgagaccccagagtcactgacctccgtccctcagctttcggggttcggcagcagaaggggcgggcccgggcctgggattggctggcgtcgtccgacccccttcgctgctctccattcgcaatcgcccgcgggcgcctgcgcgatgggtcggccgtggggagcggggcgggaagcgcttcagggcagcggatcccatgtcggccctgaggcgctcgggctacggccccagtgacggtccgtcctacggccgctactacgggcctgggggtggagatgtgccggtacacccacctccacccttatatcctcttcgccctgaacctccccagcctcccatttcctggcgggtgcgcgggggcggcccggcggagaccacctggctgggagaaggcggaggaggcgatggctactatccctcgggaggcgcctggccagagcctggtcgagccggaggaagccaccaggagcagccaccatatcctagctacaattctaactattggaattctactgcgagatctagggctccttacccaagtacatatcctgtaagaccagaattgcaaggccagagtttgaattcttatacaaatggagcgtatggtccaacataccccccaggccctggggcaaatactgcctcatactcaggggcttattatgcacctggttatactcagaccagttactccacagaagttccaagtacttaccgttcatctggcaacagcccaactccagtctctcgttggatctatccccagcaggactgtcagactgaagcaccccctcttagggggcaggttccaggatatccgccttcacagaaccctggaatgaccctgccccattatccttatggagatggtaatcgtagtgttccacaatcaggaccgactgtacgaccacaagaagatgcgtgggcttctcctggtgcttatggaatgggtggccgttatccctggccttcatcagcgccctcagcaccacccggcaatctctacatgactgaaagtacttcaccatggcctagcagtggctctccccagtcacccccttcacccccagtccagcagcccaaggattcttcatacccctatagccaatcagatcaaagcatgaaccggcacaactttccttgcagtgtccatcagtacgaatcctcggggacagtgaacaatgatgattcagatcttttggattcccaagtccagtatagtgctgagcctcagctgtatggtaatgccaccagtgaccatcccaacaatcaagatcaaagtagcagtcttcctgaagaatgtgtaccttcagatgaaagtactcctccgagtattaaaaaaatcatacatgtgctggagaaggtccagtatcttgaacaagaagtagaagaatttgtaggaaaaaagacagacaaagcatactggcttctggaagaaatgctaaccaaggaacttttggaactggattcagttgaaactgggggccaggactctgtacggcaggccagaaaagaggctgtttgtaagattcaggccatactggaaaaattagaaaaaaaaggattatgaaaggatttagaacaaagtggaagcctgttactaacttgaccaaagaacacttgatttggttaattaccctctttttgaaatgcctgttgatgacaagaagcaatacattccagctttcctttgattttatacttgaaaaactggcaaaggaatggaagaatattttagtcatgagttgttttcagttttcagacgaatgaatgtaataggaaactatggagttaccaatattgccaagtagactcactccttaaaaaatttatggatatctacaagctgcttcttaccagcaggagggaaacacacttcacacaacaggcttatcagaaacctaccagatgaaactggatataatctgagacaaacaggatgtgtttttttaaacatctggatatcttgtcacatttttgtacattgtgactgctttcaacatatacttcatgtgtaattatagcttagactttagccttcttggacttctgttttgttttgttatttgcagtttacaaatatagtattattctct

SEQ ID NO: 88 - DNA, 4529 bp, Homo sapiens
ggaacctcggctcccgggaagccccgagcctgggggaaccctgggcaccctgtgaaccctgtggtctgcactggctgccctgctgctgtcgcggggctgcgggcggacgacctgagcccgagctccgagggcccggagcggggcgccagggcctagggtcgcgggggccaggggcgcgccagggtggctgagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctcccaacagagaaattattattttacacaatccaaagcttatggtgcattaccagccagttgcagggtctgatgattggggttcaacacccacggagcagggtcgaccaagaactgtgaagagaggagttgagaacatctctgttgacattcattgtggagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaaggattcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaacatgaaacc

SEQ ID NO: 89 - DNA, 3995 bp, Homo sapiens
gggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaagggtcggcggaccggggagtgcagggctctgtcagattcagtgacagctccgtctccgcagcgattgaggaaactgtggactgagattcctgtacaatttcatcccagaaactccagacttgtagtctccatgcaagatttctttgtcggcggcttgataaacagtttctttgttttcgattttgatttcgccaatcatcattattggcattttcctgcctggtttcttcttcaagactctgaacaattgctttaacagtcaaatgatttttttttttcggtttgagctggatgggtacagcttaaatcatgggtccagcctaaaaaccaccatttaacttacactgatcaatttcaacatggactgtttttggttttttgtttttaaataaagcatcattaatgcacatctgcaggggtttgccaaacagcccaaactgtatacattacaatcattaaaagttcttattttttttaatattagtgccgttatcatggagaacagcatgacagctgtctttggcagtctgtcatttttctagcattttcagaaactcatcggaaatggcggtacctgtgtttcccttcgaaagcctctcagtacagcactcctgttcctctgttaaaactccttgttaatccagtgatcttttaggccaaggaaatattttgtgatggtgttctgggtccatacaccagcaatgaaggagatagatttgtgtacttgtgttttttaatcagcattaacatgggcaggcaccctcatttatagatgtcaggaaacattcagtgaaaaacttgtagaatgggatgtgataacgaggttccagtaatctgagcagtctaacgaggcccacctcctccaccacagaacgtggctatgttccaagtgctactctcactcagcctgttgcggatcttcatggcctcaggagacttgtttctccatgggctcttctggactgcacacttccaccatagcttgctgggttgatctagatgtctgtttgttgtatggaaattttgggggaaaaaatccaaaacacaaactgtgggttgaaatattaaccgtctccttggttccttggtattcaccgtgcctgatctgcacatttcatcgtggctgtttctgtatagcctatactgcattagcccaagagattgttgctttgtaactttttgcactattgttttggctggatttgtattacacacagttttaaaaaaaacaattccacactattctctgccttttttttcctatttatttcttcccgcacaaattccacatagaggccttcccatccagctctacgtgatttggctgcacttgaacactgattgtccatttacagccctcagcaatgtgccttctaaatggcatgacatatgtagatgtgctgcagcgcttgttaatggtcacaataaatgccacttcaccaaggaagtctcagatgaacaattatgaacatccaaattttattggggggcaataatcaactgaattgcaaaatttgggggaaaatggcactatccgtgtacgaatcgaatacaaatcaaagatttgtcacatccctaataaaaacaagatggagatgtctctgcaaccatatttgtaagcta

SEQ ID NO: 90 - DNA, 5431 bp, Homo sapiens
gggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaaggtgccagcgagatttcagattcctgtaaacctctaaagaaaaggagtcgcgcctcaactgatgtagaaatgactagttcagcatacagagacacatctgactccgattctagaggactgagtgacctgcaggtaggctttggaaagcaagtagatagcccttcagctactgcagatgcagacgtttctgatgtgcagtccatggattcaagtttgtcgagaagaggcactggaatgagtaagaaggacactgtatgtcagatttgtgaaagctctggtgactctctgattccttgtgagggagagtgctgcaaacactttcacctggagtgcctgggattggcatcacttcctgatagcaagttcatctgcatggaatgtaaaactgggcagcacccatgtttttcgtgtaaagtgtctggtaaagatgtgaagcgttgttctgttggtgcttgtgggaaattttatcatgaagcctgtgtccgcaaattccccactgccatctttgaatcaaaaggattccgctgtcctcagcactgctgctctgcctgctctatggagaaagatatccacaaagcaagtaaaggccgcatgatgagatgtttaagatgtccagttgcctatcactctggagatgcttgcattgcggccggaagcatgttagtatcctcctacattctcatctgtagtaatcattccaaacggagcagtaattcttctgctgtaaatgtaggcttttgtttcgtttgtgccagagggctgatagttcaggaccattcagaccccatgttcagttcatatgcctataagtcccactacctactgaatgaatcaaatcgtgctgagttgatgaaattacctatgattccttcttcgtcagcttccaaaaagaaatgtgagaaaggtggaagattgctctgctgtgaatcgtgcccagcttccttccacccggaatgcctaagcatagaaatgccagaaggctgctggaattgtaatgactgtaaagctggcaagaaactacattacaagcagattgtttgggtcaaattgggaaattacagatggtggccagcagagatctgcaaccccaggtctgtgccactgaacatccagggccttaaacatgacttgggggacttccctgtattcttctttggttctcatgactactactgggtacaccagggcagagtgttcccttatgttgaaggagacaaaagctttgctgaagggcagactagtattaacaagaccttcaaaaaggcactggaagaagctgcaaaacgtttccaggaattgaaagcacaaagagaaagtaaagaagccctagagattgaaaaaaactcaagaaaaccccctccctacaaacacatcaaagctaacaaagtaataggaaaggtgcagatccaggttgctgacctgtcagagattccccgctgtaactgcaagccagctgatgaaaacccttgtggcttggaatcggagtgcctgaacagaatgttgcagtatgaatgccacccgcaggtgtgcccagctggagatcgttgtcagaaccagtgctttacaaagagactataccctgatgcagagatcatcaaaacggagcggagaggctggggcctcaggaccaaaaggagcattaagaagggtgaatttgtaaatgaatacgtcggtgaattaattgatgaagaagaatgcagattgcgaatcaagcgagcccacgagaacagtgtaactaatttttatatgttaactgttaccaaggaccgtataattgatgccggcccaaaaggaaattattctcgcttcatgaaccacagttgtaatcccaactgtgaaacacaaaagtggacagtgaatggagatgttcgagtgggactatttgctctctgtgatattcctgcagggatggagttaacatttaattataacctagattgtctgggcaacggcagaacggagtgccactgtggagcagataactgcagtggttttctaggagtgcggccaaagtcggcatgtgcgtcaacaaatgaagagaaggcaaaaaatgctaagttaaaacagaagagacgaaagatcaaaacagaaccaaagcagatgcatgaagattactgttttcaatgtggagatggtggagagctggtcatgtgtgacaaaaaagactgtcccaaagcataccacctcctatgccttaacctgactcagccaccatatggaaagtgggagtgtccgtggcatcagtgcgatgagtgcagcagtgcagctgtttccttctgtgaattctgtccacattcattttgtaaagatcatgaaaagggggccctggttccctctgcactggaaggccgcctctgctgctcggaacatgaccccatggctcctgtgtcaccagaatactggagcaagataaaatgtaaatgggaatcacaagatcatggagaagaagtaaaagaataaatgtgtggtgtcccctcctttctatttaagtgaaaaaagcaaatagatcatgcatttaaaaagaagagactgctacagtgcatacagcctttgccatcggaactgccttattaaagcaaaaatgggaaaccagttcatgcaggcagaagcagttggtggtgtctggtttttgtttgatttggttggtttgggattcttttgtggagggttaaattcccttggtcttttcttgccttttattgtgcttcagtgccattgcagcttgaaaaagaaatgtttttgctgttaaaataagaacaaagagaaaagtaagttttgttaatgagataaatttaaagtctaagatgtgttccttggttgtataaagcaaaagtagccatcattcctttatttattttcatttttaggaatttcaagaagtgtagttcaatagtctaatcaagtgtgtgtgtgttttaagtaggaatctgagaaagccctctaggaaagggtatgataagctttatatacctctttactgagcagtaggtaggctcacttctctttcccttcaaaatgcttttcataggcttagagaagggctctatggaagtattaaa

SEQ ID NO: 91 - DNA, 5019 bp, Homo sapiens
acagacaagatgtcggcggatggtagcttcgagcccttgcggagaggagcatctctgtgacagaagcttgtcgacggcggcttctaggagctagtcgaaggagcgaggttgaggcgggcagcgacccgtcaggtcgctcacctgggcaccggccagctgcgagacgtgacttggggaccgcaggggagtggagagtgtgaggtgccaaagactagtaatgccccgtatccccctaggaagccgggaagccaagctccgcgggaccgcttcatgccgctgactggtgtagagcccgccagaatgaacaggaagaaaggagacaagggctttgaaagcccaaggccatataaattaacccatcaggtcgtctgcatcaacaacataaatttccagagaaaatctgttgtgggatttgtggaactgactatatttcccacagttgcaaacttgaatagaatcaagttgaacagcaaacagtgtagaatataccgagtaaggatcaatgatttagaggctgcttttatttataatgacccaaccttggaagtttgtcacagtgaatcaaaacagagaaacctcaattatttttccaatgcttatgcagctgcagttagtgctgtggaccctgatgcaggaaatggagaactttgcattaaggttccatcagagctatggaaacacgttgatgagttaaaggtcctgaagatacacatcaatttttctttggatcagcccaaaggaggtcttcattttgtggtacccagtgtagagggaagtatggcagagagaggtgctcatgttttctcttgtgggtatcaaaattctacaagattttggttcccttgtgttgattcatactctgaattgtgtacatggaaattagaatttacagtagatgctgcaatggttgctgtttctaatggcgatttggtggagacagtgtatactcatgatatgaggaagaaaactttccattatatgcttaccattcctacagcagcgtcaaatatctccttggccattggaccatttgaaatactggtagatccatacatgcatgaggttactcatttttgtttgccccaacttcttccattgctgaaacataccacatcataccttcatgaagtctttgaattttatgaagaaattcttacatgtcgttacccatactcctgttttaagactgtcttcattgatgaggcttatgttgaagtggctgcttatgcttccatgagcatttttagcacaaatcttttacacagtgccatgattatagatgagacacctttgactagaaggtgtttagcccaatccttggcccagcagttttttggttgtttcatatctagaatgtcttggtctgatgaatgggtgctgaagggaatttcaggctatatctatggactttggatgaaaaaaacttttggtgttaatgagtaccgccattggattaaagaggagctagacaaaatagtggcatatgaactaaaaactggtggggttttactacatcccatatttggtggaggaaaagagaaggataatccggcttcccatctacacttttcaataaagcatccacatacactgtcctgggaatactacactatgtttcagtgtaaagcccaccttgtgatgagattgattgaaaataggatcagtatggaatttatgctacaagttttcaataaactgctaagtctggctagtactgcttcatctcagaagttccagtcacatatgtggagtcagatgttggtttccacatctgggtttttgaaatccatttcaaatgtctctggcaaagatattcagccgttaataaagcagtgggtagatcagagtggagtggtaaaattttatggaagttttgcatttaatagaaaacgaaatgtcttggaactggaaataaaacaggactatacatctcctggaactcagaaatacgtgggaccacttaaagtgacagtgcaggagttagatggatccttcaatcatacactgcaaattgaagaaaacagccttaaacatgatataccctgccattccaaaagtagaaggaataaaaagaaaaaaatcccactgatgaatggagaagaagttgatatggatctttctgcaatggatgctgattcccctttgctgtggataaggatagacccagatatgtcagtattgaggaaggtagaatttgagcaagctgattttatgtggcagtatcagctccgctatgagagagatgttgttgcacagcaggaatccattttggctttggaaaaattccctactccagcatctcggcttgcactcactgatatattagaacaagagcagtgtttctacagagtaagaatgtcagcttgcttctgtcttgcaaagattgcaaattcaatggtgagcacatggacaggaccaccagccatgaagtcactcttcactaggatgttttgttgtaaaagttgtccaaacattgtgaaaacaaacaactttatgagctttcaaagctattttctacagaagactatgccagttgcaatggctttattaagagatgttcataatctttgtcctaaagaagtcttaacgtttattttagacttaatcaagtacaatgacaacaggaaaaataagttttcagataactattatcgtgcagaaatgattgatgccctggccaactctgttacacctgcagtcagtgtgaataatgaagttagaactttggataacttaaatcctgatgtgcgactcattcttgaagaaatcaccagatttttgaatatggaaaaacttcttccgagttacaggcataccatcactgtcagttgtttgagagccatacgggtacttcagaagaacggacatgtgccaagtgatccagctctttttaaatcttatgctgaatatggccactttgtggacattaggatagcagctttggaagcagttgttgattatactaaagtggacagaagttatgaagaactgcaatggctacttaatatgattcagaatgaccctgtaccctatgtaaggcataagattctcaacatgttgactaagaacccaccatttactaagaacatggagtctcccttatgcaatgaagccctggtagatcaactttggaaacttatgaattctggtacttcacatgactggaggttacggtgtggtgctgtggacttgtacttcacactttttggcctcagtagaccttcctgtttacccttgccagagcttgggttggttcttaatctaaaggagaaaaaagctgtcttgaatcctaccataattccagagtcagtagcaggcaaccaagaagctgcaaataatccaagcagtcacccacagctagttggatttcagaaccctttttccagttctcaagatgaggaggagattgatatggatactgttcatgatagccaggccttcatttcccatcatttaaacatgcttgaaaggccgtcaactccagggctctcgaaatatcggccagctagctcccgatctgctttaataccccagcactcagcaggctgtgacagcacacccaccacaaaaccccagtggagtttggaacttgcacggaagggaacaggtaaagaacaagcacctttggagatgagtatgcatccagcggcaagcgctccactctcagtctttactaaggaatctacagcctccaaacacagtgaccaccatcaccaccatcaccatgagcacaagaaaaagaagaagaagcataaacataagcacaaacacaagcataagcatgacagtaaagaaaaggacaaggagcctttcactttctccagccctgccagtggcaggtctattcgttctccttccctttcagactgagaaggggacaaaaagacctttcctttcatgtccagaagaatgtatgtaactaaagctttgtcctctgtgaagaattataaaagggaggggggaaaggattcgcctctcctacagaaattctgaattcatttaagttctaagcatttgatttatgttatttatacagttgggatctaattaggaaaatgtgttttgtagttctggataaactatttcatccgctgtttcctccccaaaacacacacacagagcaaactccctttcataaaagccctcatatccactggcagtccccgttcgcatcatggtctccatgtgtaccgccaaagtcaattatgtttgaaagcctttggtggatgttatggggcaaagttatgatttacacagaagcaactgccaaatctgtggtgcaaccactatctccagtgaaatattgtataacaccatttggaactactgaaaagacagtggcttttctacagtactcttccttattgcaccatttttgtattaacgtagaaactaagcatcagaatttatgaacaaagaatatgttatttttccttttgctctaaaatactgagatttggggaagcaattcttttttaaaaaaattttgaataactatcttttgataacacattcggcggttacgatgttggaatttagcagaactatcaaatccaaaattattttcaaatcaagatgtttaaattataagtttttttgttttgttttccagtaagtataaatgaaaatattcatatgtaaaatatgttttgcttaatgtggacaatttacacacccaacacatactgtttccaaaattatttctatatgacacaaagtatgatacctttaaaaaggtgagcttatatattgtttattaacctggaaatagacaatttggctctcataccataagcatttaaaaacatatgaaatattttgatttctttatatggtggtgtgtttttatttctgaattttccatgtgctttaatatttgtttaagaatattttttatatctgttcaatttttatcattccccttatcattagaaagtttgacaaaaatacttgaatcttggacctctaaatatacttttagttgtgtttaacttgtttaataaataactttttaagttg

SEQ ID NO: 92 - DNA, 1113 bp, Homo sapiens
gacgcatttccggttcccttcgtttaggtcggctggaaattatgtcctccgtcggttttccgcagtttttccaccaagcgagatatttttgggagttattccctaaataactgcattatatgctcctttcatgacgaaattgctgccgtggagaagactggaggaaactcgaggaagagggagaagccgacaagtgctcgacgggctaggaactgtcctgcttgggtgttagcgtttcccgccgggccagtaaggctgagtgacccggcgtggctactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtatagtccttcaataggaaattgtaattaaaatataattttatagaaccatttttatgtaatctgatttgaatgttatagttgataataataaaatcacttacttggttgactaaaa

SEQ ID NO: 93 - DNA, 3003 bp, Homo sapiens
cgaagtcaagacgtctggaaagaattacccagtcctggcttcgagcagcccattgaaccagagacttgaaacagccccagccaaagacttttctcccaattctgcgcttcctgggttctgctgagtcttccacaggctttttttttttttttttttttttaagacgaaaaagagattttctgttatcgggggcagaaagactgaagcacaaaaaaaaaaaaaaagaaaagaaaagaaaagaaaaaagaaaagttaatttatttttaaagcataatttttttaagaattagactgaagtgcaacggaaacataaagagaatattagtgaaattattttttaaagtggggaagaatcaaacatttaagactcccctatcctttttaaatgttgtttttaaatttcttattttttttggccggtcgtctcaaattcatctgatctcttattacctcaattttggaaactgcccgccaccgaccctccgggaccacacagacaggctgaggacgactttatgaccaagagctgaacaagatgcattgtgagaggtttctatgtatcctgagaataattggaaccacactctttggagtctctctcctccttggaatcacagctgcttatattgttggctaccagtttatccaaacggataattactatttctcttttggactgtatggtgcctttttggcatcacacctcatcatccaaagcctgtttgcctttttggagcaccgaaaaatgaaaaaatccctagaaacccccataaagttgaacaaaacagttgccctttgcatcgctgcctatcaagaagatccagactacttaaggaaatgtttgcaatctgtgaaaaggctaacctaccctgggattaaagttgtcatggtcatagatgggaactcagaagatgacctttacatgatggacatcttcagtgaagtcatgggcagagacaaatcagccacttatatctggaagaacaacttccacgaaaagggtcccggtgagacagatgagtcacataaagaaagctcgcaacacgtaacgcaattggtcttgtccaacaaaagtatctgcatcatgcaaaaatggggtggaaaaagagaagtcatgtacacagccttcagagcactgggacgaagtgtggattatgtacaggtttgtgattcagacactatgcttgacccagcctcatctgtggagatggtaaaagttttagaagaagatcccatggttggaggtgttgggggagatgtccagattttaaacaagtacgattcctggatctcattcctcagcagtgtaagatattggatggcttttaatatagaaagggcctgtcagtcttattttgggtgtgttcagtgcattagtggacctctgggaatgtacagaaactccttgttgcatgagtttgtggaagattggtacaatcaagaatttatgggcaaccaatgtagctttggtgatgacaggcatctcacgaaccgggtgctgagcctgggctatgcaacaaaatacacagctcgatctaagtgccttactgaaacacctatagagtatctcagatggctaaaccagcagacccgttggagcaagtcctacttccgagaatggctgtacaatgcaatgtggtttcacaaacatcacttgtggatgacctacgaagcgattatcactggattctttcctttctttctcattgccacagtaatccagctcttctaccggggtaaaatttggaacattctcctcttcttgttaactgtccagctagtaggtctcataaaatcatcttttgccagctgccttagaggaaatatcgtcatggtcttcatgtctctctactcagtgttatacatgtcgagtttacttcccgccaagatgtttgcaattgcaacaataaacaaagctgggtggggcacatcaggaaggaaaaccattgttgttaatttcataggactcattccagtatcagtttggtttacaatcctcctgggtggtgtgattttcaccatttataaggagtctaaaaggccattttcagaatccaaacagacagttctaattgttggaacgttgctctatgcatgctattgggtcatgcttttgacgctgtatgtagttctcatcaataagtgtggcaggcggaagaagggacaacaatatgacatggtgcttgatgtatgatcttccatgttttgacgtttgcagtcacacacaacaccttagttcctctaggggctgtacagtattgtggcatcagataatgccaccaaaggagacatatcactgctgctgggacttgaacaaagacatttatatgggtttattttcattctgccaaagtaaaacaatacatcaacaagaagaaactcagatttaacctgttatttctatgaaaatgggatgaattctttgtttatgcactttttccttactgtgcatccgcctgaaagtgttttggcctatatacctcactagccatgctttatgtgggttatcatggaagaaaaggattttggaaactcaaggaaaagttctttcaacctatacaacctaacttatggactgtttgatagatgataattttttttttttaggaaggattttctttttaactttaccaaatgaaatgccaaaggaagttttaaaggccgtggctgtgctgtatttgatataattgtactgtgtttttaaattgtgtatgccaatcttaaagacaaattttgcatattctctattttacttttctgccaaaataaacctgttcttccttttttaaaataaaataagttcttaaaaaatttatacttaaaaaatcctgcccaaaatgtgaagcttggttgactgatgttcatgatagaaagaataaaatgtttctctctctctaccttttaaaattgaatagtttatttctgtgaaagaagtatttaaactttcaatattttaactttttgtttttatttcttttagaaaaggccaatatacctatcgcg

SEQ ID NO: 94 - DNA, 3033 bp, Homo sapiens
gaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcacttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctaatctgctggcattgagctggggctgggtcaccaaacccttcccaaaaggaccttatctctttcttgcacacatgcctctctcccacttttcccaacccccacatttgcaactagaaaaagttgcccataaaattgctctgcccttgacaggttctgttatttattgacttttgccaaggctggtcacaacaatcatattcacgttattttccccttttggtggcagaactgttaccaatagggggagaagacagccacggatgaagcgtttctcagcttttggaattgcttcgactgacatccgttgttaaccgtttgccactcttcagatattttttataaaaaaagtaccactgagttcatgagggccacagattggttattaatgagatacgagggttggtgctgggtgtttgtttcctgagctaagtgatcaagactgtagtggagttgcagctaacatgggttaggtttaaaccatgggggatgcacccctttgcgtttcatatgtagccctactggctttgtgtagctggagtagttgggttgctttgtgttaggaggatccagatcatgttggctacagggagatgctctctttgagaggtcctgggcattgattcccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacttctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatatttctgacagtgagtgacccggagtctctggtgtaccctcttaccagtcagctgcctgcgagcagtcattttttcctaaaggtttacaagtatttagaacttttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttg

SEQ ID NO: 95 - DNA, 3033 bp, Homo sapiens; identical to SEQ ID NO: 94

SEQ ID NO: 96 - DNA, 3503 bp, Homo sapiens
aaaatttcccgggccgggagcgctgggcctgccgggaaggcgctgggacggttacccagcgggccgccggcggtcgtgggcaagcttcgccatgcagagcactgacctaggcaacaaggagagcggcaagatatggcaccgcaagccgtccccggccacgcgggacggaattatagtgaacattattcacaacacttccgattaccatccaaaagttttgcgatttttgaatgtggcttttgacggcacaggcgactgcttaattgctggggaccaccaaggaaatatttatgtttttgacttacatggaaacaggttcaatcttgttcagcgaacagcacaagcttgcacagctctggcctttaatcttcgtaggaaatctgaattccttgtggcattagctgattattctattaaatgttttgatacagtcaccaaggagctagttagctggatgagaggacatgaatcatcagtattttcgatctctgtgcatgcatcagggaaatatgccatcacaacttcttctgatacagcacaattatgggacttggatacctttcagagaaaaagaaagctgaatattcgccagtctgtgggtatacagaaggttttctttctaccattaagtaataccatcctcagctgttttaaagataattccatttttgcctgggaatgtgacacacttttttgcaaatatcaattgccagctccacctgaaagctctagtatattatacaaagtgtttgctgtaaccagagatggccgaatcctggctgctggaggcaagtcaaatcatcttcatttgtggtgcttggaagctaggcagctctttagaattatccagatgcccactaaagttcgagccattcgccatctggaatttcttcctgatagttttgatgctggttctaatcaggttcttggagtactaagtcaagatggtattatgagatttatcaatatgcagacttgtaaacttctctttgagattgggagcctcgatgaaggaattagctcatcagcaattagcccacatggacggtacattgcatctattatggaaaatggaagtctaaacatatattcagttcaggctttaacacaagaaataaataagccacctccgcctttagtgaaagttattgaagatttgcccaataataaactgagttccagtgatcttaagatgaaagtaacatcagggagagtacagcagccagcaaaatctagggaaagcaaaatgcaaactagaatattaaaacaagacctgactggtgattttgaaagtaaaaagaatgaattaccagatggattaaacaaaaagcgtttacaaatcttattaaaaggctatggtgaatatccaacaaaatacagaatgttcatttggcgctctctgctacaactgcctgaaaatcatactgcgtttagtaccctcatagataaggggactcatgtggcgtttctcaaccttcagaagaaataccccatcaaaagtaggaagctactcagagtattacagagaaccttatctgcattagctcactggtctgtcatttttagtgacacaccatatcttccactcttggcatttccatttgtaaaattattccagaacaaccaactcatctgttttgaagttattgctactctcataatcaattggtgtcaacactggtttgaatattttcctaatcctcctatcaatattcttagcatgatagaaaatgttttggcatttcatgacaaggaactgctgcaacacttcatagatcatgatataacctcccagctatatgcatggcctcttcttgaaactgtgttctcagaagtgctgacaagagaggagtggctgaaattgttcgataatatcttttccaaccatccttccttccttctgatgactgttgtagcctacaacatatgttctagaacgcctctgctcagctgtaatcttaaagatgactttgagtttttttttcaccatcggaataacctggatataaatgttgtgattagacaagtttatcatctcatggagaccacgcctactgacattcatccagacagcatgcttaatgtttttgttgcactgacaaaagggcagtatccagtatttaatcaatatccaaagtttattgtggactatcaaacacaggaacgagaaagaataaggaatgatgaattggattacttaagagagaggcagacagttgaagatatgcaagctaaagtcgaccagcaaagagttgaagatgaagcttggtaccagaaacaggagctgcttcgtaaagctgaagaaacaagaagagaaatgctcttacaagaggaggagaaaatgatacaacaaagacagaggctagctgctgtgaaaagagagctgaaagtaaaggaaatgcacttacaagatgctgcaagaaggcgttttctgaagcttcagcaagatcaacaggaaatggagctaagaagactggatgatgaaattgggagaaaggtatatatgagagatcgagaaattgctgccacagccagagacctagaaatgagacagctggaactcgaatcacaaaagagactttatgagaagaatcttactgaaaatcaagaagctcttgcaaaagaaatgcgagcagatgcagatgcctatagacgaaaagtggatcttgaagaacacatgtttcataagctgatagaagcaggtgaaacccagagccagaaaactcagaaggtgattaaagaaaatttggcaaaggctgaacaagcatgcctaaataccgactggcagattcagtctttacataaacaaaaatgtgatgatctacaacgaaacaaatgttaccaggaagtagccaaactccttagggaaaacagaaggaaagaaatagagataataaatgcaatggtggaggaggaagccaagaagtggaaggaagctgaaggaaaagagttccgtttgagatcagcaaagaaagcttctgctctttcagatgcgtctagaaagtggtttttaaagcaagagataaatgcggctgtagaacatgctgaaaatccatgtcataaagaagaacccaggttccaaaatgaacaggactcaagctgtttgcctagaacctcacaattaaatgactcttctgaaatggatccctcaacacagatttctttaaatagaagagcagtagaatgggacaccacgggacagaatcttattaagaaagtgagaaatcttcgccagagactcactgcccgggctcgtcacagatgtcaaacccctcatcttttggctgcatagaatgcatgtcaccttgagacggtcgagagagagacctattttgcaatcagtgacattgatttttagattatttatttaaaattcctataaagatcagccctttgtacagaaaaatgtgtctataaaaattatgtgttatttaattctgatactttttggcttgtaaatggcttcttgaactttttacaataaaaatgttttagaaactgtt

SEQ ID NO: 97 - DNA, 1348 bp, Homo sapiens
cctctccccccgggctccgcccaccccacgccgggaacccacgcgggccactacaagcccgccctttcctacgtctggtccagtcggtcttcctccggcccgggccctggcccagctagccggccatggaaggtaatggccccgctgctgtccactaccagccggccagccccccgcgggacgcctgcgtctacagcagctgctactgtgaagaaaatatttggaagctctgtgaatacatcaaaaaccatgaccagtatcctttagaagaatgttatgctgtcttcatatctaatgagaggaagatgatacctatctggaaacaacaggcgagacctggagatggacctgtgatctgggattaccatgttgttttgcttcatgtttcaagtggaggacagaacttcatttatgatctcgatactgtcttgccatttccctgcctctttgacacttatgtagaagatgcctttaagtctgatgatgacattcacccacagtttaggaggaaatttagagtgatccgtgcagattcatatttgaagaactttgcttctgaccgatctcacatgaaagactccagtgggaattggagagagcctccgccgccatatccctgcattgagactggagattccaaaatgaacctgaacgatttcatcagtatggatcccaaggtaggatggggcgccgtctacacactatccgaatttacacatcggtttggcagtaaaaactgctgaacttggtctcaagatgtggaactgtggagaaattctaggacatgaacaagctatcctttcatcgaggacagcaaacattatggtacagttggcttggaattatgtctttctcttttaatttgattgagtggaaatctgagtgaatacaaatataaatgaacaacataaaaacttttgttttgacatgtcaaattgaaacttgataaagtgcgtacttgctaagatattcctgtggctcatgcgttacaacacgaggacttaagccagtaatcgtttttgttcagatagaggtgtggaggtagagccagcccctcatgtctgttttggatgttttgtgtctctccagctacattgtaagttccttgagggcagggccatggcccattgctctgtgaatctcaaatgcccataaaaggtgcccataaaatgttttcttgaacatttgaatgtgctgttgtctggaaaggggtaatattgtgagctgaatcagcaataagtattagtctttttggactatggtattgttaaaaagactgcagccctctcagacttgagcgttaattggcttatttatttatggctttaaataaaatcgatttaacgtt

SEQ ID NO: 98 - DNA, 1475 bp, Homo sapiens
cgttgctgtcggtaaactttgcctgtaggaggactgatctcttaatgaaatacagaaaaaccatctcagaaaaaggaaaatgggcaatcgtcatgctaaagcgagcagtcctcagggttttgatgtggatcgagatgccaaaaagctgaacaaagcctgcaaaggaatggggaccaatgaagcagccatcattgaaatcttatcgggcaggacatcagatgagaggcaacaaatcaagcaaaagtacaaggcaacgtacggcaaggagctggaggaagtactcaagagtgagctgagtggaaacttcgagaagacagcgttggcccttctggaccgtcccagcgagtacgccgcccggcagctgcagaaggctatgaagggtctgggcacagatgagtccgtcctcattgagttcctgtgcacgaggaccaataaggaaatcatcgccattaaagaggcctaccaaaggctatttgataggagcctcgaatcagatgtcaaaggtgatacaagtggaaacctaaaaaaaatcctggtgtctctgctgcaggctaatcgcaatgaaggagatgacgtggacaaagatctagctggtcaggatgccaaagatctgtatgatgcaggggaaggccgctggggcactgatgagcttgcgttcaatgaagtcctggccaagaggagctacaagcagttacgagccacctttcaagcctatcaaattctcattggcaaagacatagaagaagccattgaagaagaaacatcaggcgacttgcagaaggcctatttaactctcgtgagatgtgcccaggattgtgaggactattttgctgaacgtctgtacaagtcgatgaagggtgcggggaccgatgaggagacgttgattcgcatagtcgtgaccagggccgaggtggaccttcaggggatcaaagcaaagttccaagagaagtatcagaagtctctctctgacatggttcgctcagatacctccggggacttccggaaactgctagtagccctcttgcactgagccaagccagggcaataggaacacagggtggaaccacctttgtcaagagcacattccaaatcaaacttgcaaatgagactcccgcacgaaaacccttaagagtcccggattactttcttggcagcttaagtggcgcagccaggccaagctgtgtaagttaagggcagtaacgttaagatgcgtgggcagggcaccttgaactctggcttagcaagcatctaggctgcctcttcactttcttttagcatggtaactggatgttttctaaacactaatgaaatcagcagttgatgaaaaaactatgcatttgtaatggcacatttagaaggatatgcatcacacaagtaaggtacaggaaagacaaaattaaacaatttattaattttccttctgtgtgttcaatttgaaagcctcattgttaattaaagttgtggattatgcctct

SEQ ID NO: 99 - DNA, 3312 bp, Homo sapiens
acagcagcaacggcagaggccagcgggcgaggtcaagatggtggctccgcgggcgggggaggcagtggagggaggaggagtcagaccttagccagccggaaacaccgaaacccagagacctcctggggagccgccgccgccgccctctcggccatcgctgcctccgccgcctgctccacctcgagggacgcgagcgggcggcggggctggccgtgagagagacaggagaggaaggagggcaggggcggagttgcccgccttagcccccgcccccggccgcggccccgggccctgccccgcgcggccctgcccggcccaccgagccctggtgtggcagcggctcatggcggccgtggggcccccgcagcagcaggtgcggatggcccatcagcaggtctgggcggcgctcgaagtggcgctccgggtgccctgcctttacatcatcgacgccatcttcaactcctacccggattccagccaaagccggttctgcatcgtgctccagatcttcctccggctctttggtgtatttgcatccagtattgttctgatcttgtcacaacgatcacttttcaagttttacacgtacagctcagcctttctgttagctgcaacttcagtgttggtgaattattatgcttctttgcacattgacttctatggtgcctacaacacgtcagcttttggaattgagctgcttcctcgaaaaggtccctcgctgtggatggcacttatcgttctacagctaacatttggaattggatacgttacactactccagattcattccatctattcacaattaattattttggatctcttggttcctgtaataggcttaatcacagagctaccattacacatcagagagactttactgtttacttcttccttgattctcacattaaatacagtgtttgtcctggcagtgaaactgaagtggttttattattccacacgatatgtttatcttttggtgaggcacatgtatcgaatttacggattacagttattgatggaggacacatggaagaggattcgtttcccagacatactacgagtcttttggctaacaagagttacagctcaggctacagtgttaatgtacatcttaaggatggcaaatgaaactgattccttctttatttcttgggatgatttttgggacctcatttgcaatcttataattagtgggtgcgattctacactaactgtactgggcatgagtgctgtaatttcctcagtagcccattatttggggcttggaatattggcctttattggatcaactgaggaagatgacaggcgtcttggctttgttgcacctgttttattttttattttggctcttcagactgggttaagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtaattgtttctctcactgtttatacgttattcatgattgatggctactataatgtcctctgggaaaagcttgacgattatgtctactacgttcgttcaacaggcagtattattgaatttatatttggagttgtaatgtttggaaatggggcttacactatgatgtttgagtcgggaagtaaaattcgggcttttatgatgtgcctacatgcatattttaacatctacttacaagccaaaaatggctggaagacatttatgaatcgtaggactgctgtgaagaaaattaattcacttcctgaaataaaagggagccgcttacaagaaataaatgatgtatgtgcaatctgctatcatgagtttacaacatctgctcgtattacaccgtgtaatcattatttccatgcactttgccttcggaaatggctgtacattcaagatacttgtccaatgtgccatcagaaagtatacatcgaagatgatatcaaggataattcaaatgtatctaacaacaatggatttattccacccaatgaaactccagaggaagctgtaagagaagctgctgctgaatctgacagggaattgaacgaagatgacagtacagattgtgatgatgatgttcaaagagaaagaaatggagtgattcagcacacaggcgcagcagctgaagaatttaatgatgatactgactgatgaaaatagcatttattaatgattgaggtatttgtttaaaattcagttcatccaaaatggagtaatatccttcaccttcagtgtgtaaccaagcacaaaaacagtatcaatgttgaatctgtgaatggttttccgtttactgtgatgtgctactgtaaatatacctctttaattacttctggtctctttggtgacctgtttaaatttgtgtacattattgtacatagaataaaatgttttcacatttttatgacaaaatttgaacaaatagctttttaatagatgtaatgatcatatggtgcgtcacctgtgccaaatattcttcaatgaaattatataatgtaactttggacctcagtttttctttagaaatgggtgggagaatgaaaatgcaaatcaggaaaccacattaaagtcaaggaaataaaataatttgaccagaggataaaggacatgagagagtattttaaaactaaagaaaaaattagctgccagaagcaactgaggaccttttttgaaacttgagtagcagtgtaattgagctgagtttgaaagtcctgattcagagagagactgagggttgacaaataaactgtatcaactaaactttgatataaaccagaatgtgctaaatgttttttatgtaaaattgtatatttgttagccattctgtgtctgcagtattgtcataaaattgtcctttcattcttttgaagatattacaaaacaaaaatagttttttttaaattgttttaaactaagatactcaatgatataaaaacatcctgatctgattttacgagaaaaagaaggggaatggtggggaatggtgtgtaccgatatatagtatttctttagacaacttgcagataatttctttattgaaactatcaggaagttttactatgaaattttacatacatgatggaaagtggaagacatataccaattatattccaggaaaaaatacttta

SEQ ID NO: 100 - DNA, 3925 bp, Homo sapiens
ctaataatatacagacaccagctctgaggccagttaatcatccccagtgtccaggcacagagtagtcggtccgcctcacaatgttggactttctagctgagaacaacctctgtggccaagcaatcctaaggattgtttcctgtggtaatgccatcattgctgaacttttgagactctctgagtttattcctgctgtgttcaggttaaaagacagagctgatcaacagaaatatggagatatcatatttgatttcagctattttaagggtccagaattatgggaaagcaaactggatgctaagccagagctacaggatttagatgaagaatttcgtgaaaacaacatagaaattgtgaccagattttatttagcatttcaaagtgtacataaatatattgtagacttaaacagatatctagatgatctcaatgaaggggtttatattcagcaaaccttagaaactgtgcttctcaatgaagatggaaaacaacttctatgtgaagcactgtacttatatggagttatgctactggtcattgaccaaaagattgaaggagaagtcagagagaggatgctggtttcttactaccgatacagtgctgctcgatcttctgctgattcaaatatggacgatatttgtaagctgcttcgaagtacaggttattctagccaaccaggtgccaaaagaccatccaactatcccgagagctatttccagagagtgcctatcaacgaatccttcatcagtatggtcattggtcgacggagatctgatgatatttacaaccaggtctcagcgtatcctttgccggagcatcgcagcacagccctggcaaaccaagctgccatgctgtacgtgattctctactttgagccttccatccttcacacccatcaagcaaaaatgagagagatagtggataaatactttccagataattgggtaattagtatttacatggggatcacagttaatctagtagatgcttgggaaccttacaaagctgcaaaaactgctttaaataataccctggacctttcaaatgtcagagaacaggcaagcagatatgctactgtcagtgaaagagtgcatgctcaagtgcagcaatttctaaaagaaggttatttaagggaggagatggttctggacaatatcccaaagcttctgaactgcctgagagactgcaatgttgccatccgatggctgatgcttcatacagcagactcagcctgtgacccaaacaacaaacgccttcgtcaaatcaaggaccagattctaacagactctcggtacaatcccaggatcctcttccagctgctgttagatactgcacaatttgagtttatactcaaagagatgttcaagcaaatgctttcagaaaagcaaaccaaatgggagcattacaagaaagagggttcggagcggatgactgagcttgctgatgtcttttcaggagtgaaacccctaaccagagtggagaaaaatgaaaaccttcaagcttggttcagagagatctcaaaacaaatattgtctttaaattatgatgattctactgctgcgggcagaaaaactgtacaactgatacaagctttggaagaggttcaagaattccaccagttggaatccaatctgcaagtatgtcagtttcttgccgatactcgaaagtttcttcatcaaatgatcagaaccattaacattaaagaggaggttctgatcacaatgcagatcgttggggacctttctttcgcttggcagttgattgacagtttcacatccatcatgcaagaaagcataagggtaaatccatccatggttactaaactcagagctaccttcctaaagcttgcctctgccctcgatctgccccttcttcgtattaatcaggcaaatagccccgacctgctcagcgtgtcacagtactattctggagagttggtatcctatgtgagaaaagttttgcagatcatcccagaaagcatgtttacatctcttctaaagatcataaagcttcagacccacgacattattgaagtgcctacccgcctggacaaagacaagctgagggactatgctcagctaggcccacgatacgaggttgccaagcttactcatgctatttccatttttactgaaggcatcttaatgatgaaaacgactttggttggcatcatcaaggtggatccaaagcagttgctggaagatggaataaggaaagagcttgtgaagcgcgttgcctttgccctgcataggggactgatattcaaccctcgagccaagccaagtgaattgatgcccaagctgaaagagttgggagcgaccatggatggattccatcgttcttttgaatacatacaggactatgtcaacatttatggtctgaagatttggcaggaagaagtatctcgtatcataaattacaacgtggagcaagagtgtaataactttctaagaacgaagattcaagattggcaaagcatgtaccagtccactcatattccaatacccaagtttacccctgtggatgagtctgtaacgtttattggtcgactctgcagagaaatcctgcggatcacagacccaaaaatgacatgtcacatagaccagctgaacacttggtatgatatgaaaactcatcaggaagtgaccagcagccgcctcttctcagaaatccagaccaccttgggaacctttggtctaaatggcttagacaggcttctgtgctttatgattgtaaaagagttacagaatttcctcagtatgtttcagaaaattatcctgagagacagaactgttcaggacactttaaaaaccctcatgaatgctgtcagtcccctaaaaagtattgtcgcaaattcaaataaaatttatttttccgccattgccaaaacacagaagatttggactgcgtatctcgaggctataatgaaggttgggcagatgcagattctgagacaacagattgccaatgaattaaattattcttgtcggtttgattctaaacatctggcagctgctctggagaatctcaataaggctctcctagcagacattgaagcccactatcaggacccttcacttccttaccccaaagaagataacacacttttatatgaaatcacagcctatctggaggcagctggcattcacaacccactgaataagatatacataacaacaaagcgcttaccctattttccaattgtaaactttctatttttgatcgctcagttgccaaaacttcaatacaacaaaaatctgggaatggtctgccgaaaaccgaccgacccggttgattggccaccacttgtcctgggactgctcactctgctgaagcagttccattcccggtacaccgagcagttcctggcgctgattggccagtttatctgctccacggtggagcagtgtacaagccagaagatacctgaaattcctgcagatgttgtgggtgcccttctgttcctggaggattatgttcggtacacaaagctacccaggagggttgctgaagcacatgtgcctaatttcatttttgatgagttcagaacagtgctgtaactgtttttcctacttcttcaatggaaggattgtccttagatcttcccaccatcacaaatgaatttgaagatgaaaagaaactcagttgctcatacaactgcattttttctgtctattatgggaaacatcagacgttctgagtaagatatatctcatggcattagttaatataactgatattgtttaaatcatggtattacatgcaatttatatcagataaaagcagaacacatttttgtactgcctctcttaaatgctgaatgtaactgttatgtataaatccatttagttttatgttctaaagaactatttgtgcaactccagattttcagtaaaatagtattactagtaaaaaaaaaaaaaaa

SEQ ID NO: 101 - DNA, 2189 bp, Homo sapiens
gcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaaaaaaaaaaaaaaaaaaaa

SEQ ID NO: 102 - DNA, 2219 bp, Homo sapiens
ggcaggtgttgaggggctcccggtccggctgccgccgctcccccgctccggacccggggctccccctagcgccgctgaggagccgcctctgcggctccaggagggcgcaggagcgggactgagagcgcctggaggctcgagcggagggtaattcatttgcacacctgttagcaagaaacagaagttgaaggactggaacaagtgaactaggaaagagggaacgccaatccaaggatagaaggacaaggacagaatcaccagcactggctgaaggcctcctgtttcctgcgctttctccttttcctgtgaaatctccgaggagaagaaagaatgatggacagtttatcctttcactgccacaaggcctgtttacttggcagtaggtccttaagttccttgcttttttgctgctgtttggtgactggaagaggcaccagagactctcactctggggaggtttgctggcatgggtaatctcattaaggtgctaaccagggacatagaccacaatgcagcacattttttcttggactttgaaagtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagaggcaatccagcatccagcagatgagaagttgcaagagaaggcatggggtgcagttgttccactagtaggcaaattaaagaaattttacgaattttctcagaggttagaagcagcattaagaggtcttctgggagccttaacaagtaccccatattctcccacccagcatctagagcgagagcaggctcttgctaaacagtttgcagaaattcttcatttcacactccggtttgatgaactcaagatgacaaatcctgccatacagaatgatttcagctattatagaagaacattgagtcgtatgaggattaacaatgtaccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattctgcttgagggtaatggtgggtgtcataatactctatgaccacgtacatccagtgggagcatttgctaaaacttccaaaattgatatgaaaggttgtatcaaagttcttaaggaccaacctcctaatagtgtggaaggtcttctaaatgctctcaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaaaaaaaaaaaaaaaaaaaaaaaaa

SEQ ID NO: 103 - DNA, 5454 bp, Homo sapiens
gctgacgtcgccggggcccggcgtcgcgtcagggctggccggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcggtagtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtatcaggagttgggatttctcagcactgctaatgaagatcccctcttatagtccaataagcttatcaggacttccagagtcatgacatgaacagtttaattgaacccatccactctgggcaggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgcaaaacagtcagaaatttttattgccttttgagattctccaacttgacaaatgtgccaaagatcaacagacagaaaatatcatcctgtgtatttacttgtcatactttaactttgtgaaagatcttactgataaatgaaaagctttagcagaggtggtattgtggggtaattgcttaaatttacatatcaaagtaaaaaagtagtgcctgtaaaaaaaaaaaaaaaaaa

SEQ ID NO: 104 - DNA, 2747 bp, Homo sapiens
ggaatacctgttattgaatatgcttcctattttatgagaggttatgcaatctaactcatttgattattaaatttgataacctaccatgttcagctatcatgtaaatattgttatctctatatttatgtttatgtagttacctgtgaaagtagctttgaaaatgtgacacatatttttattagtgtaattacattttaattaatttttaatacttcacatgttttgtgtttttcctttggaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggtatgaaatggtagcatttgatttttttcaaggttcccactggaatgatcacggagctctagtatctacgtaattgaaattccccttttgatcagatatgggaataggaagctaattaattgatgatatatttttaactctgccttctccaaggtatacagataactacagacttcattagtgtttgatttcatagactggcattaaagcctttgtctccaaaatttgaaggcctggagacaggcatcccagggtataagcttccagctggatcacctttaactagcttacaaaaagacccttacacaaatactttccatttgtgagttaaaacagggttttttgacatcgaataaagcttcttttgtaagaagtttcttttatattgtaacaattggtgttgttagactgactatgtgttttatgaattgatcaatgagccatacatttttgctaggatgtatattttaataactacaaaaaaagagagtttaaaaaactattaagggtctgtctttaaaccacctaatagaggaatttaaaagtgaaggttgcagttgctagattttgccttggctaccttcagattcccacaatacttgtacataatgaactgtgcatgcttttacattctctaagggcttaacttcttaggcactgtaagactataagaacgcagtaatagccataactggatttccttggttctcctgttttaaaatctgagccttaatgtagttttaatatatcctttttgtattacttttctttattagtagcctaataaagaagactttgagtatcttttgctctcctctagatgcgttttaaaaactattccaaatttaattgatattgtattgagtttttcagggttattttaggcctgatttgataacaatgcgttgttttggtgcctccattaatgttgtattaaatcaatgggtcttttaaattgattaatatgtcattgaatcataccttctgattttctgtgatcatccaacggttaagtctttgccgttattgtcaatatatcaaccaaattttaaataactttttttactgtgtattactatattcaacgtcccagatataacaatattttgtattttcaccactgtttatggtattctcagaatgcgataaatcagggacttgggtaataaaatgtttctggaaaattcattacaatgtcaatctttgattatgcacaatcctgctgaggtgaatgtgattgtgaaaagtacttattaaatgtggaagttagtgtagagggcagtacccgtcttagagagaagtacagaaaaccacgttttgaaattgaatttaaaaaagaaaggaaaattgtgtaactcggctgtttctattttcataattaaaaacttttgagagtccttgccagttttgtaacaaagagaccaacaatcattaatgaaaaccttgtaaattattttagattttcaggaacaccatgccattccctcattttctacttgtcattcaggttgatttcaatgtgaaaatgttttgtgaacaaacacttatttttatcctatgtgttagcctcgcttcatagttaaaaagccgagttataaagctcttaattacatctcaattggtatcagcaatagacctaaaggagaggtattgattgttactaacctctgtttcctaatgagttaaagtaatgtcactcatgacatagattgataacaggcctgtagtcaaaacttactgtgctaatggacttatttatattttttaaaaattcaaactgtggtcttgaaccccaattctcagcttattaattatagattatttaattgtattagggatatgtcatgttatatttacttttggataaaacttgcattagatgcataataactcagtaagttttaaaaacaatgttaatttttccttgtttagaagttaagcaccttatcaagatattaagttttaaaatcttgttttataactttgtaacttgagagtaatggatgctgtagtgatgtctttcacatatgtgaagatgaacaataaaattgtttatttacaagtaaaaaaaaaaaaaaaaaaa

SEQ ID NO: 105 - DNA, 2281 bp, Homo sapiens
gctgacgtcgccggggcccggcgtcgcgtcagggctggccggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcggtagtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtatcaggagttgggatttctcagcactgctaatgaagatcccctcttatagtccaataagcttatcaggacttccagagtcatgacatgaacagtttaattgaacccatccactctgggcaggtgactggaatagctgattaaaacataaatgctgcttttaggttaaccacaaaggaacaactcaggatcagtcgtgattgctaaagtattcacttttatcttttaggtaagagaaaagaaaaagataaggaaagaagagagaagagagacaaagatcactacagaccaaaacagaagaagaagaaaaaaaaaaaaaa

SEQ ID NO: 106 - DNA, 3256 bp, Homo sapiens
gctgacgtcgccggggcccggcgtcgcgtcagggctggccggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggtatgaaatggtagcatttgatttttttcaaggttcccactggaatgatcacggagctctagtatctacgtaattgaaattccccttttgatcagatatgggaataggaagctaattaattgatgatatatttttaactctgccttctccaaggtatacagataactacagacttcattagtgtttgatttcatagactggcattaaagcctttgtctccaaaatttgaaggcctggagacaggcatcccagggtataagcttccagctggatcacctttaactagcttacaaaaagacccttacacaaatactttccatttgtgagttaaaacagggttttttgacatcgaataaagcttcttttgtaagaagtttcttttatattgtaacaattggtgttgttagactgactatgtgttttatgaattgatcaatgagccatacatttttgctaggatgtatattttaataactacaaaaaaagagagtttaaaaaactattaagggtctgtctttaaaccacctaatagaggaatttaaaagtgaaggttgcagttgctagattttgccttggctaccttcagattcccacaatacttgtacataatgaactgtgcatgcttttacattctctaagggcttaacttcttaggcactgtaagactataagaacgcagtaatagccataactggatttccttggttctcctgttttaaaatctgagccttaatgtagttttaatatatcctttttgtattacttttctttattagtagcctaataaagaagactttgagtatcttttgctctcctctagatgcgttttaaaaactattccaaatttaattgatattgtattgagtttttcagggttattttaggcctgatttgataacaatgcgttgttttggtgcctccattaatgttgtattaaatcaatgggtcttttaaattgattaatatgtcattgaatcataccttctgattttctgtgatcatccaacggttaagtctttgccgttattgtcaatatatcaaccaaattttaaataactttttttactgtgtattactatattcaacgtcccagatataacaatattttgtattttcaccactgtttatggtattctcagaatgcgataaatcagggacttgggtaataaaatgtttctggaaaattcattacaatgtcaatctttgattatgcacaatcctgctgaggtgaatgtgattgtgaaaagtacttattaaatgtggaagttagtgtagagggcagtacccgtcttagagagaagtacagaaaaccacgttttgaaattgaatttaaaaaagaaaggaaaattgtgtaactcggctgtttctattttcataattaaaaacttttgagagtccttgccagttttgtaacaaagagaccaacaatcattaatgaaaaccttgtaaattattttagattttcaggaacaccatgccattccctcattttctacttgtcattcaggttgatttcaatgtgaaaatgttttgtgaacaaacacttatttttatcctatgtgttagcctcgcttcatagttaaaaagccgagttataaagctcttaattacatctcaattggtatcagcaatagacctaaaggagaggtattgattgttactaacctctgtttcctaatgagttaaagtaatgtcactcatgacatagattgataacaggcctgtagtcaaaacttactgtgctaatggacttatttatattttttaaaaattcaaactgtggtcttgaaccccaattctcagcttattaattatagattatttaattgtattagggatatgtcatgttatatttacttttggataaaacttgcattagatgcataataactcagtaagttttaaaaacaatgttaatttttccttgtttagaagttaagcaccttatcaagatattaagttttaaaatcttgttttataactttgtaacttgagagtaatggatgctgtagtgatgtctttcacatatgtgaagatgaacaataaaattgtttatttacaagtaaaaaaaaaaaaaaaaaaa

SEQ ID NO: 107 - DNA, 3074 bp, Homo sapiens
aacaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcagcggaaaaaaaaaaaaaaaaaaaaaaaaaaaaaaaaaaaaaaaaaa

SEQ ID NO: 108 - DNA, 4442 bp, Homo sapiens
gaccactgtgagcccgcggcgtgaggcgtgggaggaagcgcggctgctgtcgcccagcgccgccccgtcgtcgtctgccttcgcttcacggcgccgagccgcggtccgaagtcttgctgtgtcacccaggctgccaggctggagtggagtggcatgatctcggctgactgcaacctctgcctcccagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 109 - DNA, 4453 bp, Homo sapiens
gaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccagatcctgcagctccaccaaagaaaccgcctcgccctggagctcccggtcatctgggaagccttgccagcctcagcagccctgctgacagctacaacgagggtgtcaagcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaa

SEQ ID NO: 110 - DNA, 2208 bp, Homo sapiens
gggcaccgtaaccagcgccgcggacaccggcaccggcgccacggactccgcaggaccccgcgcccgccgccgccgctatgctggggctgctggtggcgttgctggccctggggctcgctgtctttgcgctgctggacgtctggtacctggtgcgccttccgtgcgccgtgctgcgcgcgcgcctgctgcagccgcgcgtccgtgacctgctagctgagcagcgcttcccgggccgcgtgctgccctcggacttggacctgctgttgcacatgaacaacgcgcgctacctgcgcgaggccgactttgcgcgcgtcgcgcacctgacccgctgcggggtgctcggggcgctgagggagttgcgggcgcacacggtgctggcggcctcgtgcgcgcgccaccgccgctcgctgcgcctgctggagcccttcgaggtgcgcacccgcctgctgggctgggacgaccgcgcgttctacctggaggcgcgctttgtcagcctgcgggacggtttcgtgtgcgcgctgctgcgcttccggcagcacctgctgggcacctcacccgagcgcgtcgtgcagcacctgtgccagcgcagggtggagccccctgagctgcccgctgatctgcagcactggatctcctacaacgaggccagcagccagctgctccgcatggagagtgggctcagtgatgtcaccaaggaccagtgaccgccaccttcacaccgtctgccctggccaccatcctgggcctgggggctgcccacagatgggcagtctcagccatactctgttccagctggagtagcctcctgaccagcctggcccaccctgctccacccactgggcccccccagttattgatacccctctgtgctgggctccacgctaggcagaaggaggagtggcattggcatcctgacccagctctgccctcaaggtggggatggatgggcaaaggagagtcctgcctggccctacgatgaggccactcatgtgggcctaggtaggggaggatggtgcctggagcagagggacccacaagtgcctcccgagcctagatcctggctcggaccactgcaagggccgaggcagggccagaccagagcatcctgggtacaggcctgggctctccagggcctgggcctgattcaggtgcagtgggcactcctgaagggtcagagcggcatctgccaggcagcccctctggcttccgctgaggtggttgcaggcctggggcagagcctgggtggtcagaggccggggctagaggcagatggaagggaggcatttgctgacagaggacggggcacccgggctccccactgcagtcggccttgcctcctcctcctcctctacctccagtcaggctggacgggagggtagccttgtggctgagaggggtcagactaggtggcacaggggctcctggaaagacagcaggcttcctgctgggcgttcccttgttggagggaatagagtgggggtgggactctgcaggggtgtccttgtccactcgcacccctcgccgcccaccagggccatgctctgtgacttgggctgatccccaccctttctgggcctacagcaccacaggccgctgtacccccttagagctgcccctctctggcctggccggcaggcgtcttcttaactcctctgtcctctatattcagcatgttccttgtcagctgctgggccggccctgccttgcgctagcagagcctctcctggcagcttctcaggtctccctaatggagacaccaggctactaggacactggctggggccaccccctcctgcctaatgcctcaccttacagctggggaaactgaggcctggaatggcccagagtcaccaaggcaaagttggggctggtcccagcctgaggctccagctgatgccctcagctcccagagagggggtgccccatctagctgggtgcaggggtcactgcttgtcagctcagggccctgtgcccgcttgcctgttcccctacatctgtgcctgcacatccagaactgcctccttgccgctgcctccaggaagcccaccttgagccagagtcaagggctgcagcactgcccgatagaacacgcccgccctcactgctgttcttgccttacagccaccatgggaaagctgcaacctttctgttttatttaaagaaagcccaacattaaagggttttcattgcaaaaaaaaaaaaaaaaaa

SEQ ID NO: 111 - DNA, 3268 bp, Homo sapiens
cggtctcgggagatggaggaaaaggagatgttacggcggcagatccgcctactgcagggtctgattgatgactacaaaaccctccacggcaatgccccggcccctggtaccccagcagcttctgggtggcagccacccacttaccacagtggcagagcctttagtgcccgctaccctcgtccaagccggaggggctactcttcccaccatgggccttcgtggcgcaagaaatactccctcgtgaatcggcccccgggaccctcagaccctcctgccgaccatgctgtgcggccgttgcacggggcccgggggggccggcctcctgtcccgcagcagcatgtccttgagagacaggtccagctcagtcagggtcagaacgtggtcatcaaagttaaaccgccatcaaagtctggctctgccagtgcctcaggggcccagcggggctctttggaagaatttgaggaaaccccctggagtgaccaaaggccccgggaaggtgaaggtaagccccctcggggacagctgcagccctcgaggccaacaagagccagggggacctgcagtgtggaagatcctcttctggtctgccagaaggagcctggtaagcccaggatggtgaagtcagtgggcagtgtgggcgacagcccccgggagccccgccggacagtcagtgagagtgtgattgccgtcaaggcgagcttcgcatcctccgctctgcccccacgcactggcgtggccctgggccggaagctgggttctcattccgtggccagctgtgctccacagctccttggggacaggagagtagatgctggccacacagatcagccagttccgtctggctcagtggggggccccgccagaccggcctcaggacccaggcaggcccgggaggcctcgctggttgtgacctgtcgaactaacaagttccggaaaaacaactacaaatgggtggctgcctcctcgaagagtccccgggttgctcggagggccctcagtcccagagtggctgcagagaatgtgtgcaaggcctctgctggcatggcaaacaaggtggagaagccgcagctcatagctgacccagagcccaagcccaggaagccagccacgtcctccaagccagggtctgcccccagcaagtacaagtggaaggcctccagcccctctgcctcctcctcttcctccttccgttggcagtcggaggccagcagcaaggaccatgcctcccagctctccccagtcctgtctaggtccccgtcgggggacagaccagcagtaggacacagtggcttgaagcccctctctggggagaccccgctctcggcttacaaagtgaagagccgcaccaagatcatccggagacgcggcagcacaagccttcctggagacaagaaaagcggcacctcacctgccgccaccgccaagagccacctcagcctccggcggagacaggccctcagggggaagagcagccctgtcctgaagaagacccccaacaagggcctggtacaggtcaccacgcaccgactatgtcgcctgccaccgagccgggcccacctccccaccaaggaagcgtccagcctgcatgccgtgcggactgcacccaccagcaaggtgatcaagacccgctaccgcattgtcaagaagacgccggcctcgcctctcagcgccccgcccttccccctgtctctgccctcctggcgggcccggcggctctcactatccgggtccctggtgctgaaccacctgcgtccagttgccagcgggggtgggaaagcccaaccgggctccccttggtggcggagcaaaggctaccgctgcatcggaggggtcctctacaaagtatctgccaacaagctctccaagacctccggccagcccagtgatgcgggcagcaggcccctcctgcgcacaggctggctggatcctgcaggcagctgtagccgttccctggccagccgggcagtgcagcgcagcctggccatcatccggcaggcgcggcagcgcagggagaagaggaaggagtactgcatgtactacaaccgcttcggcaggtgcaaccgtggcgagcgctgcccctacatccacgatcccgagaaggtggccgtgtgcaccaggtttgtccggggcacctgcaagaaaacggatgggacctgccccttctcccaccatgtgtccaaggagaagatgcgggtgtgctcctacttcctgaagggcatctgcagcaacagcaactgtccctatagccacgtgtacgtgtcccgcaaggccgaggtctgcagcgacttcctcaaaggctactgccccctgggtgcaaagtgcaagaagaaacacacgctgctgtgccccgactttgcccgcaggggggcgtgtccccgcggcgcccagtgccagctgctccaccgtacccagaaacgccacagtcggcgggcagccacgtcccccgccccagggcccagcgacgcaaccgccaggagcagggtctcggccagccacgggcccaggaagccttcagcatcccagcgccccaccaggcagacgcccagctcggctgccctcactgcggctgccgtggctgcacctccccactgcccaggggggtcagcctctccctcatcctcgaaggcttcgtcctcctcctcctcctcctcatcccctcccgcttccttggaccacgaggcaccatctctccaggaggctgccttagcagcagcgtgctccaacaggctctgcaagctgccttccttcatctccctgcagtcctcgccgagcccaggagcccagcccagggtccgggcccctagggcccccctcaccaaggactcagggaagcctctgcacatcaaaccacgtctgtgaggaccccagggaccggcctgcacctacctcagaccctcatccttggagaggaaagaggctctgtccaccactctaccccacaggagggccgcccgccaccaagcctcacctgggggccacagggacactgctctgcctgcctggccctcaaccttccatgaccagcgtgtgcgcagggcctggtcttcctcccccaagccaggcccctgtccccaccccaccaccttccagggtgccaggcagggctggcctccaggcctgtccccgactgccattggcaacagtggccctgcagcccccagccctccccacccaggttttcggcccagtgaagaggccactggccaggcctcccaggcaggtgttttatgttcagcaataaaggttctatccgaaaaaaaaaaaaaaa

SEQ ID NO: 112 - DNA, 3361 bp, Homo sapiens
agtggcccaggtgccccctatcccagcggaggcccgctatggcctctgacccccaaagcctcagccttggacaggtggctcatggagctccaggcacagagaaggccctggaggacgcagctggggtggggcgacactctggctgggttttgcagtgggtccctggtgacactctggctgggttttgcagtgggtccctgcaccacgctcaggaggtgacagcttgtttcctcccagccagaggcagccattctagtggacagagccctctgtgttagagcaggtctgggcgtcaggcctcactgtccctggctggaggtgctcatggtaccgtagacaacagggagaacactgtaattctgtgttggggagggccggggacagaagctttctgctagtgggagcatcccgggatgagccgggcagggctgttctggagggaaggagtcccccatcatgggagacatccaagtactgacccttctcccactccctcccgcccgccccgagagcacaatgcctgacccatttcccctcctcaggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggtgggcccgaagagggcagggcagggcagggccccacccaccccaagcaaccctgcttttatttatttatttatttaaattattttttgaggtgaggttttgctatctcggccagggtggtcttgaactcctggcctcaagcagtcctcctgcctcggcctcccaaagtgctgggattacaggggtgagccactgtgccaggtcccagccttgctcttgggaaggtcacaaccttggggcatcaggaaagtcccagaggcaaaagagcgctgtggccggaaccagcttgcaggaaggaagctgcaggggtcatctggggcctccgctgccaggactggatcctaaggaccggactgagccccaggctgctgtgaggacaaggggtggtgtgaacacgggggcccaggtgagggggccgcacctcgagtctggacttggagtccccgagtccaccttccctcatggggtcccgtccccgtggggagcgcacggagaggctgccggtgccccggcacccacagacctctggagggcccctctgcaccacctcccccggtggcgtggggctgtcaggggagggaagacgccttcaggggctgcggcccagcgagctttgctgctcctcggacacaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcaggtgtgtagccagccccgggccacgcctggccccccacgtgggcacgcggcggcgggtgacggaggcggcgggctgggctccgccaaggcccctcggagcagctcccagccctgcgcttggctgcggagccgaagtcacctggcggcgggcctgcccccggcacccggcccgcacccgcaccccacggcccggtgccagggcccagccccgagcccatctccatgcctcagggtgagggccagggccatctgagccagaagaagacggtcaccatcccctcaggcagcaccctcgcattccgggtggcccagctggttattgactctgacttgggtgagctggagttgggggtgtctcgggcccaggccctggcagagaagcagggaggcctggggagagctacccgccagcttgggctgccgtgggcccctggctgaacaacgtcctgtgtctggcaggtggctgaggtcctgtgctctggtgtgtgggtgattgggcagggcctgagctggacaggggagctcctagtaggggaggggaggggatgctgggatctaggtgacatgcctgtccctgtctgctcccgtctggctgccagacgtccttctcttcccggataagaagcagaggaccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggaggaggcggtgagcgggggagggtgcccggggcacacaaggcctgcccagccagccagactcacctgcccttcccgtgcccacagctggagcagggccagagccttgggccggtggagcccctggacggtccagcaggtgctgtcctggagtgcctggtgttgtcctccggaatgctggtgccggaactcgctatccctgttgtctacctgctgggggcactgaccatgctgagtgaaacgcagcacaagctgctggcggaggcgctggagtcgcagaccctgttggggccgctcgagctggtgggcagcctcttggagcagagtgccccgtggcaggagcgcagcaccatgtccctgccccccgggctcctggggaacagctggggcgaaggagcaccggcctgggtcttgctggacgagtgtggcctagagctgggggaggacactccccacgtgtgctgggagccgcaggcccagggccgcatgtgtgcactctacgcctccctggcactgctatcaggactgagccaggagccccactagcctgtgcccgggcatggcctggcagctctccagcagggcagagtgtttgcccaccagctgctagccctaggaaggccaggagcccagtagccatgtggccagtctaccatggggcccaggagttggggaaacacaataaaggtggcatacgaagg

SEQ ID NO: 113 - DNA, 994 bp, Homo sapiens
ccctttcatcagtcttcccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggcaaaaaaaaaaa

SEQ ID NO: 114 - DNA, 2216 bp, Homo sapiens
ccctttcatcagtcttcccgcgtccgccgattcctcctccttggtcgccgcgtccttggctggcgttagagacagggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgacggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgggtggcctggtgcctcgaagctgcctccctgtctcaccgacccggtcctcggtctggcctgtccgtgtccagcctgagacccaacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggcaaaaaaaaaaa

SEQ ID NO: 115 - DNA, 1312 bp, Homo sapiens
ctagaattcagcggccgctgaattctagaacccaggtgcaactgacatgggtgaaccccagggatccatgcggattctagtgacagggggctctgggctggtaggcaaagccatccagaaggtggtagcagatggagctggacttcctggagaggactgggtgtttgtctcctctaaagacgccgatctcacggatacagcacagacccgcgccctgtttgagaaggtccaacccacacacgtcatccatcttgctgcaatggtggggggcctgttccggaatatcaaatacaatttggacttctggaggaaaaacgtgcacatgaacgacaacgtcctgcactcggcctttgaggtgggggcccgcaaggtggtgtcctgcctgtccacctgtatcttccctgacaagacgacctacccgatagatgagaccatgatccacaatgggcctccccacaacagcaattttgggtactcgtatgccaagaggatgatcgacgtgcagaacagggcctacttccagcagtacggctgcaccttcaccgctgtcatccccaccaacgttttcgggccccacgacaacttcaacatcgaggatggccacgtgctgcctggcctcatccacaaggtgcacctggccaagagcagcggctcggccctgacggtgtggggtacagggaatccgcggaggcagttcatatactcgctggacctggcccagctctttatctgggtcctgcgggagtacaatgaagtggagcccatcatcctctccgtgggcgaggaagatgaggtctccatcaaggaggcagccgaggcggtggtggaggccatggacttccatggggaagtcacctttgatacaaccaagtcggatgggcagtttaagaagacagccagtaacagcaagctgaggacctacctgcccgacttccggttcacacccttcaagcaggcggtgaaggagacctgtgcttggttcactgacaactacgagcaggcccggaagtgaagctggaagacaggatcaggtgccagcggaccatcggctggcagagcccagcggccaccacccgtcaaccctgccaggagctgagggcaccacccagcaacctgggcctgcattccatccgctctgcagccccaagcatctttccagtggggcccccattcacgttggtcctcagggaaaccagggtccggggcaggcccggcgctttgctccccacaccagccccctgcgcgtgtccactctgatcctgcatcccactccctgggagccaataaagtgcattttcacagaaaaaaaaaa

SEQ ID NO: 116 - DNA, 1312 bp, Homo sapiens; identical to SEQ ID NO: 115

SEQ ID NO: 117 - DNA, 5146 bp, Homo sapiens
ccatgctcaagtgcatcccgctgtggcgctgcaaccggcacgtggagtcggtggacaagcggcactgttcgctgcaggccgtgccggaggagatctaccgctacagccgcagcctggaggagctgctgctcgacgccaaccagctgcgcgagctgcccaagccttttttccggctgctgaacttgcgcaagctgggcctgagcgacaacgagatccagcggttgcctcccgaggtggccaacttcatgcagctggtggagctggacgtgtcccggaacgatatccctgagatcccggagagcatcaagttctgcaaggctctggagatcgcggacttcagcgggaaccccctctccaggctccctgatggcttcactcagctgcgcagcctggctcacctggccctgaatgatgtgtctctgcaggcactgcccggggacgtgggcaacctcgccaacctggtgaccctggagctccgggagaacctgctcaagtccctgccagcgtccctgtcatttctggtcaagctggaacagctggatctgggaggcaacgatctggaagtgctgccagacactctgggggctctgcccaatcttcgggagctgtggcttgaccggaaccagctgtcagcactgcccccggagctcgggaacctgcggcgcctggtgtgcctggacgtgtcggaaaaccggctggaggagctgcctgctgagctcggcgggctggtgctgctcactgacctgctgctgtcccagaacctgctgcggaggctgcccgacggcatcggtcagctgaagcagctatccatcctaaaggtagaccagaatcggctgtgcgaggtgactgaggccatcggggactgtgagaacctctctgagctgatcctcacggagaacctgctgatggccctgccccgctccctgggaaagctgactaagctgaccaacctcaacgtggaccggaaccacctcgaggcgctgccgcccgagatcgggggctgtgtggcactcagcgtcctctccttgagggacaaccgcctggccgtcctgccaccagagctggcccacacgacagagctgcacgtgctggacgtggcggggaaccgcctgcagagtctgccgttcgcgctcacccacctcaatctcaaggccctgtggctggcagagaaccaggcgcagcccatgctccggttccagacggaggatgatgcccggaccggcgagaaggtgctcacctgctacttgctgccccagcagcccccactcagcctcgaggatgctgggcagcaggggagcctctcggagacctggagcgatgccccgccgagccgcgtcagcgtcatccagttcctggaggcccccataggtgatgaggacgctgaggaagctgcagctgagaagcggggcctacagcgccgggccacacctcaccccagcgagctcaaggtgatgaagaggagcatcgaggggcggcggagcgaggcctgcccttgccagccagactctgggtcgcccttgcctgcagaggaggagaagcggctgagtgccgagtctggcctgagtgaagactctcgcccatctgccagcacagtctctgaggctgagcccgagggcccgtcggctgaggcacagggtgggagccagcaggaagccacgactgctggcggggaggaagacgccgaagaggactaccaggagcccacggtgcatttcgcagaggacgcactgctgcccggggatgacagggagatcgaggaggggcagcctgaggccccctggaccctgccaggcgggaggcagcggctcatccgcaaggacacacctcactacaaaaagcacttcaagatctccaagctgccccagcccgaggccgttgtggctctgctgcagggcatgcagcctgatggggagggccctgtggctcccgggggctggcacaatggcccccacgcaccctgggctcctcgggcccagaaggaggaggaggaggaggaagagggtagtcctcaggaggaggaggaagaggaggaggaggaaaacagggctgaagaggaagaggccagcactgaggaggaggacaaggagggggccgtggtttctgcgccctctgtcaagggagtgtcgtttgaccaggccaataacctgctgatagagcctgctcgcattgaggaggaagagctgaccctcaccatcctgcggcagactgggggcctgggcatcagcattgcgggcggcaagggctccacaccctataagggggacgacgagggcatattcatctctcgggtgtccgaggaaggccctgcggcccgggctggagtccgtgtgggtgacaagctcctggaggtgaatggtgtggctctgcagggcgccgagcaccacgaggccgtggaggcgctccggggggccggcactgccgtgcagatgcgagtgtggcgggagcgcatggtggagcctgagaacgcggtcaccatcacgccgctgcggcccgaggatgattacagcccccgagagcggcggggaggggggctgcgcctgcccctgctcccgcctgagagccccgggcccctccgtcagcgccacgtggcctgcctggcacgcagcgagagggggctgggcttcagcattgctggtgggaaaggctccacaccctacagggctggtgatgcgggcatcttcgtctcccgcattgccgagggcggtgctgctcaccgcgcgggcacactgcaggttggcgaccgcgtcctctctattaatggagtggacgtgactgaggccaggcatgaccacgccgtctccctgctgaccgctgcctcccccaccatcgccctgctgttggagcgggaggctgggggccctcttcctcccagccctctgccacattcctcaccccccaccgctgctgttgccaccaccagcataaccactgccacccccggggtgcctgggttgccgagcctggcccccagcctgctggctgccgcgttggaagggccatacccagtggaggagatccgtctgccaagagctgggggccctctggggcttagtattgtcggaggctccgaccattccagccacccgtttggtgtccaggagcctggtgtgttcatctccaaggtgctcccgcggggcctggccgctcgcagcggcctgcgggttggggaccgcatcctggcagtgaacgggcaagacgtgcgggatgccacgcaccaagaagcagtcagtgccctgctccggccctgcctggagctgtcgctgctggtgcggagggacccggcacccccgggcctacgggaactgtgcatccagaaggcacctggggagaggctgggcatcagcatccgcgggggtgccaggggccacgctggcaacccccgcgaccccacagacgagggcatcttcatctccaaggtgagccccacgggggcagccgggcgcgacggtcggctgcgtgtgggtttgcggctgttggaggtgaaccagcagagcctgctgggcctgacgcacggcgaggcggtgcagctgctccgcagtgtgggcgacaccctcaccgtgctggtctgtgacggcttcgaggccagcaccgacgcagccctggaggtgtccccaggtgtcattgccaacccctttgcggcaggcatcggccaccggaacagcctggagagcatctcttccatcgaccgggagctgagccctgagggcccaggcaaggagaaggagctgcctggacagaccctgcactgggggcccgaggccacagaagccgcaggtcggggtctgcagcccctgaagctggactaccgcgccctggccgccgtgcccagcgctggcagcgtgcagagggtaccgtctggagcagctggagggaagatggctgaatctccctgctcccctagtggccagcagccgccctccccgccttctccggatgagctgcccgccaatgtgaagcaggcctacagggccttcgcggccgtgcccacttctcacccgcctgaggatgcccctgcccagccccccacgcctgggcctgcagcctccccggagcagctgtccttccgggagcggcagaagtactttgagctggaggtgcgcgtgccccaggccgagggcccccctaagcgcgtgtccctggtgggtgctgacgacctgcggaagatgcaggaggaggaagccagaaaactacagcagaagagagcgcagatgctgcgggaggcggcagaggctggggccgaagcgaggctcgccctggacggggagacgctgggcgaggaggaacaggaggatgagcagccaccctgggccagcccgagccccacctcaaggcagagcccggcgtcccccccgcccctgggaggtggcgccccggtgcggacggccaaagctgaacggcgccaccaggagcggctgcgcgtgcagagtccggagccaccggcacccgagcgtgccctgtcccctgccgagctccgggccctggaggccgagaagcgtgcgctgtggagggcagccaggatgaagtcattggaacaggacgctctccgagcacagatggtcctcagcaggtcccaggaaggccggggcacgcgggggcccctggagcgactggccgaggccccttcccctgcgcccaccccgtcgcccacccctgtggaagacctcggcccccagaccagcacctccccgggacgcctgtcaccggactttgctgaggagttgaggtccctggaaccatctcccagccctggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacattttaaaaaaaaaaaaaa

SEQ ID NO: 118 - DNA, 4095 bp, Homo sapiens
atgtccctcctcagcagctatgagggcctgcggcaggagatccagcggctggcacaggagaacgaagagctgcggcggctggtgcagctcatccaggagaaccaggagctgaagctggtgctcaggaaccgcggcagcagcctgggcttctgcagctccgggttcctggctgaggtggctgccagtccctggctacccaggcggagaacgatcaaattcaagaatgctgagagagggctaccagctgaagagctcctgtgggactccagccccaccaccatgggcagccccgagggccgcttccactttgccatcgaccgtgggggtaccttcacagacgtctttgcccagtgcccaggggggcacgtgcgggtcttaaaactgctctcagaggaccctgccaactatgcggacgcgccaaccgaaggcatccgccgcatcctggagcaggaggccggcatgctcctgccccgggaccagccgctggactccagtcatatcgccagcatccgcatgggcaccacagtggccaccaacgcactgctggagcggaagggggagcgggtggcgctgctggtgacacgtggcttccgagacctgctgcacattggcacccaagcccgtggggacctctttgacctggccgtgcccatgcctgaggtgctgtatgaagaggtgctggaggtggacgaacgcgtggtgctgcaccgtggagaggcgggcaccgggacgcctgtgaaaggccgcacgggggacctgctggaagtgcagcagcctgtggacctgggggccctgcgtgggaagctggaggggctgctatctcgaggcatccgcagcctggctgtggtgctcatgcactcgtacacgtgggcccagcatgagcagcaggtgggtgtgctggcccgggagctgggcttcacgcacgtgtcactgtcctcggaggccatgcccatggtgcgcatcgtccctcgggggcacacggcctgtgccgacgcctacctcacgcccgccatccagcgctacgtgcagggcttctgccgtggcttccagggccaactcaaggatgtgcaggtgttgttcatgcgctccgatggcggcctggcgcccatggacaccttcagcggctccagtgctgtgctctcgggcccggccggcggcgtggtgggctactcagccaccacctaccagcaggagggtggccagcctgtcatcggctttgacatgggaggcacgtccacggatgtgagccgctatgctggggaattcgagcacgtcttcgaggccagcacagctggcgtcaccctccaggccccgcagctggacatcaacaccgtggcagcgggagggggttcccgcctcttcttcaggtctggcctctttgtggttgggcccgagtcagcaggagcccacccaggacccgcctgctaccgcaaagggggccctgtgacagtgacggatgctaatctggtcctgggtcgcctgctgcctgcctccttcccctgcatttttgggccgggagagaaccaaccactttcccctgaggcctcccgcaaagccctggaggctgtggccactgaggtcaacagcttcctgaccaacgggccctgcccggcctccccgctgagcctggaggaggtggccatggggttcgtgcgcgtggccaacgaggccatgtgccggcccatccgtgcactcacgcaggcaagaggccatgacccctcagcccatgtgctggcctgctttgggggagctggtgggcagcatgcatgtgccatcgcccgggccctgggcatggacacggtgcacatccacaggcacagtgggctgctgtcggccctggggctggccctggctgacgtggtgcatgaggcacaggaaccctgctccctgctctacgcgcctgagaccttcgtgcagctggaccagaggctgagccgcctggaggagcagtgtgtggatgctctgcaggcccagggcttccccaggtcccagatcagcactgagagcttcctgcacctgcgctaccagggcacggactgtgctctgatggtgtctgcccaccagcacccagccacagcccgctcgccccgtgcgggggacttcggggcagcctttgtggagcggtacatgagggagtttggctttgtcatacctgagcggccggtggtcgtggacgatgtgcgagtgcggggcaccggccgcagtggtcttcgcctcgaggatgcccccaaagcccagaccgggcctccccgggtggacaagatgacccagtgctactttgaggggggctaccaggagacccctgtgtacctgctggcagagctgggctatgggcacaagctccatgggccctgcctcatcatcgacagtaacagcaccatcctggtggagccaggttgccaggcagaggtgaccaagacaggggacatctgcatctccgtgggggccgaagtccccggcacagtgggcccccagctggaccctatccagctgtccatcttctcacaccgcttcatgagcattgctgagcagatgggccgcatcctgcagcgcacagccatctccaccaacatcaaggagcgtctggacttctcctgtgccctctttgggcccgatggggggctggtgtccaatgccccccacatccctgtgcacctgggtgccatgcaggagacggtgcagttccagattcagcacctgggggccgatctccaccctggcgacgtgctactgagcaaccatcccagtgccgggggcagccacctgccagacctgactgttatcacaccggtgttttggccgggtcagacgcggcctgtgttctatgtggccagccgagggcaccacgcagacatcgggggcatcacaccaggctccatgcccccccactccaccatgctgcaacaggagggtgccgtctttctgtccttcaaacttgtccaggggggcgtcttccaggaggaggcggtgacggaggccctgcgggcgccaggcaaggtccccaactgcagcggaaccagaaacctgcacgacaacctgtcggacctccgtgcccaggtggcagccaaccagaagggcatccagctggtgggggagctcattgggcagtacggcctggacgtggtgcaggcctacatgggccatattcaggcaaacgctgagctggccgtgcgagacatgttgcgtgcctttggaacctcccggcaggcccggggcctgcccctggaggtgtcctcggaagaccacatggacgacggttcccccatccgcctccgtgtgcagatcagcctgagtcagggcagcgccgtgtttgacttcagcggcactgggccggaggtgtttggtaatctcaacgcaccgcgggccgtaaccctgtccgccctcatctactgcctgcgctgtctggtgggccgcgacatcccactcaaccagggctgcctggcgccagtgcgcgtggtcattccccgaggctccatcctggacccgtcgcccgaggcggcggtggtgggcggcaacgtgctcacgtcgcagcgcgtggtggatgtcatcctgggggcctttggggcctgcgccgcctcccagggctgcatgaacaacgtgaccctgggcaacgcccacatgggctactacgagacggtggcgggcggcgcgggcgcgggtcccagctggcacgggcgcagcggtgtgcacagccacatgaccaacacacgcatcaccgaccctgagatcctggagagccgaggccgcttccgaggcggcgacggcgtcacccgcgagctgctctttcgtgaggaggcgctgctgtcagtgctgaccgagcgccgcgccttccggccatacgggctccacgggggcgagcctggcgcccgcggcctaaacctgctgatccgcaaaaacggccggacggtgaatctgggcggcaagacgtcggtgaccgtgtaccccggggatgtgttctgtctccacacgcccggcggcggtggctatggggacccggaggaccccgccccaccgccggggtcgcccccgcaagcactggcctttcccgagcacggcagcgtctatgagtatcgccgggcccaggaggccgtgtga

SEQ ID NO: 119 - DNA, 896 bp, Homo sapiens
  misc_feature 886: n = A,T,C or G
acctccggaaaccgtagattccgggcggtcggagccgccgggagctgtagttctcccgcggctcagagaagtaggcagagagcggacctggcggccgggcagcatggcggggctggagctcttgtcggaccagggctaccgggtggacgggcggcgcgccggggagctgcgcaagatccaggcgcggatgggcgtgttcgcgcaggctgacggctcggcctacattgagcagggcaacaccaaggcactggctgtggtctacggcccgcacgagatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgcccaggctgcccgagatgtgcacaccctcttagatcgagtggtccggcagcatgtgcgtgaggcctctatcttgctgggggactgaccacccagccacccatgtccagaataaaccctccttgcccacacnaaaaaaaaaa

SEQ ID NO: 120 - DNA, 896 bp, Homo sapiens; identical to SEQ ID NO: 119
  misc_feature 886: n = A,T,C or G

SEQ ID NO: 121 - DNA, 896 bp, Homo sapiens; identical to SEQ ID NO: 119
  misc_feature 886: n = A,T,C or G

SEQ ID NO: 122 - DNA, 2047 bp, Homo sapiens
gcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctttatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagc

SEQ ID NO: 123 - DNA, 2047 bp, Homo sapiens; identical to SEQ ID NO: 122

SEQ ID NO: 124 - DNA, 2047 bp, Homo sapiens; identical to SEQ ID NO: 122

SEQ ID NO: 125 - DNA, 1273 bp, Homo sapiens
caagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 126 - DNA, 1765 bp, Homo sapiens
aaattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcgggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagccacaggacctagccctcagcacccccagaagatggacggggaacttggacgcttgtttcccccatcattggggctaccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagcc

SEQ ID NO: 127 - DNA, 2441 bp, Homo sapiens
gggccacacagcggacccctaagcggaccgctggcaccggtcgggtggcagcagagtgtcgctcgacatgggggaggccggggctggcgctggcgcctcgggagggccggaggcaagcccggaggcagaggtggtgaagctgctgcccttcctggcgccgggcgcgcgggcggacctgcaggcggcggcggtgcggcacgtgctggcgctgactggctgcggacccggccgcgcgctgttggcggggcaggcggcgctgctgcaggcgctgatggagctggcgccggcctctgccccggcccgggacgccgcccgcgcgctcgtgaacttggccgccgaccccggcctgcacgagacattgctggcggccgaccccgggctgccagcgcgcctgatgggccgcgcgttggacccgcagtggccctgggccgaggaggcggccgccgcgctagccaacctcagtcgcgagccggcgccgtgtgcagcgctcatggcggcgctggcggccgcggagccggcagactcgggcctggagcggctggtgcgcgcgctgtgcacgcccggctacaacgcccgcgcgcccctgcactacctagcgccgctgctctccaacctcagccaacgccctgcggcgcgggccttcctactggaccccgacaggtgcgtggtccagcggctgctgccccttacccagtaccccgactcctctgtacgcaggggcggggtggtggggacgctgcggaattgctgcttcgagcaccgacatcacgagtggttgcttggacctgaggtggacattctcccctttttgctcctgcccttggctgggcctgaggatttctccgaggaagagatggaacggctgcctgtcgacttgcagtacctgccaccagacaagcagcgagaacctgatgcagacatccgcaagatgcttgttgaagccatcatgctgctgacagccacagcaccaggtcggcagcaggtgcgggaccagggagcctacctgatccttcgagagctgcacagctgggagccggagcccgacgtgcggacggcttgtgagaagctcatccaggtgcttattggggacgagcctgaacgtggcatggaaaacctgctggaggtgcaggtgcctgaggatgtggagcagcagctgcagcagctggattgcagggagcaggagcagttggagcgggagctggccccagagccatgggtggagagggccacacccacctgaggcccctgcagccggacaccagctccagggtcccctttgccaggctttctcagaccaggccttcctgcagctgtctgcaggccccctgggtccccttgttcagagactgtgctcttctgagaagcagagctacgcttaggctccagtaaggattggaggcactttccagccctgtgcagtgttgctaccagcaagaatgaaggttgtgcagagcagtactgtgaggtaggcaccgtgactcggctgcctgtgcagaaggtggaggtggcaggcggatggccagggagccatgagaagactcttcctgggcacggcgtggggactggacagaaaaccactgcaagccccaaggagccagctgaagcctcccaatccccagggcactgcagagtctgggcagaggtgggcgcataggtacaagtgctgctttgtcagcctcactccctgcagctctcagctccctgttccctgagacctggcctcaaagggctgacccagccatacgtagatcctggggtctttctaggactgtgcctccctgcttgacctatgctccaggaccctgccctcaacccttgtcagctccctaagtcttcctgtttcccagtctcagattgagtgggtgctctcattggcctctctagctaggccgtctccctggtcagcttccttgagcctgggccactcctccctggccttcttacctctgccaagagcctccagatgtgcctgcagcctagtccctgcccaagcttctcccccagccaccctctgcccctgtggtagagcccactataggcccaggcgccttacgtgcttctcccctggacctatgtgcatccctcacctgccagttatgtggctgccaagccccacaggctgtcatggtggctcttgccacacttcccttcctgagctgacctgacctcactgccacctcttgcattgggatcctgagggctggcccctgctcactgatgggccctcccaggcccgtcaagccctggtgaaggagcttagcttgtcttcttggcaattcacaatgcctcactccacaccctaaaactggagcgtcccctatggtctcctgctgtggcttgggtgccgggcgtctcccgcctccaggatctcctctcacctgcccccattaaagctctgccactcaaaaaaaaaaaaaaaaaaaaaaaaaaaaaaaaaaaac

SEQ ID NO: 128 - DNA, 1976 bp, Homo sapiens
gaatggacgagagaggcggccgtccattagttagcggctccggagcaacgcagccgttgtccttgaggccgacgggcctgacgcgggcgggttgaacgcgctggtgaggcggtcacccgggctacggcggccggcagggggcagtggcggccgttgtctagggcccggaggtggggccgcgcgcctcgggcgctacgaacccggcaggcccacgcttggctgcggccgggtgcgggctgaggccatgggcgaccgcggcagctcccggcgccggaggacagggtcgcggccctcgagccacggcggcggcgggcctgcggcggcggaagaagaggtgcgggacgccgctgcgggccccgacgtgggagccgcgggggacgcgccagccccggcccccaacaaggacggagacgccggcgtgggcagcggccactgggagctgaggtgccatcgcctgcaggattctttattcagctctgacagtggcttcagcaactaccgtggcatcctgaactggtgtgtggtgatgctgatcttgagcaatgcccggttatttctggagaacctcatcaagtatggcatcctggtggaccccatccaggtggtttctctgttcctgaaggatccccatagctggcccgccccatgcctggttattgcggccaatgtctttgctgtggctgcattccaggttgagaagcgcctggcggtgggtgccctgacggagcaggcgggactgctgctgcacgtagccaacctggccaccattctgtgtttcccagcggctgtggtcttactggttgagtctatcactccagtgggctccctgctggcgctgatggcgcacaccatcctcttcctcaagctcttctcctaccgcgacgtcaactcatggtgccgcagggccagggccaaggctgcctctgcagggaagaaggccagcagtgctgctgccccgcacaccgtgagctacccggacaatctgacctaccgcgatctctactacttcctcttcgcccccaccttgtgctacgagctcaactttccccgctctccccgcatccggaagcgctttctgctgcgacggatccttgagatgctgttcttcacccagctccaggtggggctgatccagcagtggatggtccccaccatccagaactccatgaagcccttcaaggacatggactactcacgcatcatcgagcgcctcctgaagctggcggtccccaatcacctcatctggctcatcttcttctactggctcttccactcctgcctgaatgccgtggctgagctcatgcagtttggagaccgggagttctaccgggactggtggaactccgagtctgtcacctacttctggcagaactggaacatccctgtgcacaagtggtgcatcagacacttctacaagcccatgcttcgacggggcagcagcaagtggatggccaggacaggggtgttcctggcctcggctttcttccacgagtacctggtgagcgtccctctgcgaatgttccgcctctgggctttcacgggcatgatggctcagatcccactggcctggttcgtgggccgctttttccagggcaactatggcaacgcagctgtgtggctgtcgctcatcatcggacagccaatagccgtcctcatgtacgtccacgactactacgtgctcaactatgaggccccagcggcagaggcctgagctgcacctgagggcctggcttctcactgccacctcaaacccgctgccagagcccacctctcctcctaggcctcgagtgctggggatgggcctggctgcacagcatcctcctctggtcccagggaggcctctctgccctatggggctctgtcctgcacccctcagggatggcgacagcaggccagacacagtctgatgccagctgggagtcttgctgaccctgccccgggtccgagggtgtcaataaagtgctgtccagtgggag

SEQ ID NO: 129 - DNA, 1952 bp, Homo sapiens
cttccggtcgtgggccatgccgggggcgggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacgctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaatgagttggcattaaggaagccaatacct

SEQ ID NO: 130 - DNA, 4463 bp, Homo sapiens
ctgtcccggttcctctcgagtcggctccaactgccagcccgggttggcgccatgtacgccgtgtacaaacaggcgcatccgccacccggtctggagttctccatgtactgcaacttcttcaacaacagcgagcgcaacctggtagtggccgggacctcgcagctctacgtgtaccgcctcaaccgcgacgccgaggctctgaccaagaatgacaggagcacagaggggaaggcccaccgggagaagctcgagcttgctgcctccttctccttctttggcaacgtcatgtccatggccagcgtgcagctggcaggagccaagcgggatgccctgctcctaagcttcaaggatgccaagctgtctgtggtggagtacgacccgggcacccatgacctgaagaccctgtcactgcactactttgaggagcctgagcttcgggacgggtttgtgcagaatgtacacacgccgcgagtgcgggtggaccccgacgggcgctgtgcagccatgcttgtctacggcacgcggctggtggtcctgcccttccgcagggagagcctggctgaggagcacgaggggctcgtgggtgaggggcagaggtccagcttcctgcccagctacatcatcgacgtgcgggccctagacgagaagctgctcaacatcatcgacctgcagttcctgcatggctactacgagcctaccctcctcatcctgtttgagcccaaccagacctggcctgggcgcgtggccgtgcggcaggacacgtgctccattgtggccatctcactgaacatcacgcagaaggtgcaccccgtcatctggtccctcaccagcctgccctttgactgcacccaggctctggctgtgcccaagcccataggtggggtggtggtgtttgccgtcaactcgctgttgtacctgaaccagagcgtccccccgtatggcgtggctctcaacagtctcaccacaggaaccacggctttcccgcttcgcacccaggagggtgtgcggatcaccctggactgcgcccaggccaccttcatctcctacgacaagatggtcatctccctcaagggcggcgagatctacgtgctgaccctcatcaccgacggcatgcgcagtgtccgagcgttccactttgacaaggcggccgccagcgtcctcaccaccagcatggtcaccatggagcccgggtacctgttcctgggttctcgcctgggcaattccctcctcctcaagtacacggagaagctgcaggagcccccggccagtgctgtccgtgaggctgccgacaaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagccaaggagagtttcgggggcatgcgcctgctgcgtcgggcagacttccacgtgggtgcccacgtgaacacgttctggaggaccccgtgccgggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgc

SEQ ID NO: 131 - DNA, 2317 bp, Homo sapiens
aaaactccaggaggcggaggaggctagtggcagtacctgggcaccctgaccctccccacaggccagagcccaccctcctgctcatgagggcagacaggcctttccagggacacagtccctcttctccccaggaccccagggccaactccccctgccggccctctgccatcaaattggcagtggctccaggggagtcccctggggatgggggaccactgttggggacccctctgcgtgcacccctgtagttggggaagcaggacaggggcctggggagacggaagggcgccaggggttgagagaggatggtggacgttgttggacttgaaagggaaacaggccctcggggaagcccctggccaggcctgcctctcccctccctggtgggcccagcgcccctgctcacttgtctctgcccacagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacgctcgggctggcctctgggcctctcatgcagaccacctcctggccctgctcgagagccccaaggccctgaccccgggcctgagctggctgctgcagaggatgcaggcccgggctgccggccagacccccaagacggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtatgcctgagtgccagggacgtgatggctgcatatggactgtcggaacaggctggggtgaccccggaggcctgggcccaactgagccctgccctgctccaacagcagctgagtggagcctacacctcccagtccaggccccccgtccaggaccagctcagccagtcagagagatatctgtacggctccctggccacgctgctcatctgcctctgcgcggtctttggcctcctgctgctgacctgcactggctgcaggggggtcgcccactacatcctgcagaccttcctgagcctggcagtgggtgcactcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggtgtgtccctgcagctggcacccagcgagctccggcagcccaagcccccccacgagggctcccgcgcagacctggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtcttacgtggcactcgcggttggagtcagcgaggagagcgaggcctggatcctggcagtggccaccggcctgttccttacgtagcactctgcgacatgctcccggcgatgttgaaagtacgggacccgcggcccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaacccagaagcccctatagaggccccagtcccaactccagtaaagacactcttgtcccttggaaaaaaaaaaaaaaaaaaa

SEQ ID NO: 132 - DNA, 2192 bp, Homo sapiens
agtctggccctggacaaccccagcaaagccgccctcagccagcccagaagcactgggccttggccacagcaacacccactgagcacgctgggagctgagtatggcgtccctggtctcgctggagctggggctgcttctggctgtgctggtggtgacggcgacggcgtccccgcctgctggtctgctgagcctgctcacctctggccagggcgctctggatcaagaggctctgggcggcctgttaaatacgctggcggaccgtgtgcactgcaccaacgggccgtgtggaaagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacactcgggctggcctctgggcctctcatgcagaccacctcctggccctgctcgagagccccaaggccctgaccccgggcctgagctggctgctgcagaggatgcaggcccgggctgccggccagacccccaagacggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtatgcctgagtgccagggacgtgatggctgcatatggactgtcggaacaggctggggtgaccccggaggcctgggcccaactgagccctgccctgctccaacagcagctgagtggagcctgcacctcccagtccaggccccccgtccaggaccagctcagccagtcagagaggtatctgtacggctccctggccacgctgctcatctgcctctgcgcggtctttggcctcctgctgctgacctgcactggctgcaggggggtcgcccactacatcctgcagaccttcctgagcctggcagtgggtgcactcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggtgtgtccctgcagctggcacccagcgagctccggcagcccaagcccccccacgagggctcccgcgcagacctggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttggaaaaaaaaaaaaaaaaaaaaaaaaa

SEQ ID NO: 133 - DNA, 1065 bp, Homo sapiens
cgctgaccgagcgcaccccgcccccggcgccatcttcccgaccgcgagccgtccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgaccttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 134 - DNA, 1160 bp, Homo sapiens
cgctgaccgagcgcaccccgcccccggcgccatcttcccgaccgcgagccgtccaggtctcagtgctgtgccccccccagagcctagaggatgtttcatgggatcccagccacgccgggcataggagcccctgggaacaagccggagctgtatgaggaagtgaagttgtacaagaacgcccgggagagggagaagtacgacaacatggcagagctgtttgcggtggtgaagacaatgcaagccctggagaaggcctacatcaaggactgtgtctcccccagcgagtacactgcagcctgctcccggctcctggtccaatacaaagctgccttcaggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggtgggtgtccctcccagccaggcagagccccgcagtgcccgagaccctcccagccaggcggagccccgcagtgcccctgaggccctcagcccccacatgccctgtgctgcactcccaggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaactttgggggccgggcccctccccacaataaagatgctctccgaccttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 135 - DNA, 1200 bp, Homo sapiens
cccgctccgtcctcctcgcctgccaccggtgcacccagtccgctcacccagcccagtccgtccggtcctcaccgcctgccggccggcccaccccccaccgcaggccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgcccagcgtgccacctcagctctcttctctcctctcctttccattctctctatggggaggggagagcaggcaggaggagcagaaattgccaacattgcacagccaggctgggagcagcctagggagagcccccatcatgcccaccacccactctggcactggcttcatcctttacctatccccttccaccctcctttgcttgcttaataaattctgaacttggaaaaaaaaa

SEQ ID NO: 136 - DNA, 8187 bp, Homo sapiens
cccgagaagcggcggggcggcgggccggcgggcggggcgcagagccaggcagcgcaggtatagccaggctggagaaaagaagctgccaccatggttgcactttcactgaagatcagcattgggaatgtggtgaagacgatgcagtttgagccgtctaccatggtgtacgacgcctgccgcatcattcgtgagcggatcccagaggccccagctggtcctcccagcgactttgggctctttctgtcagatgatgaccccaaaaagggtatatggctggaggctgggaaagctttggactactacatgctccgaaatggggacactatggagtacaggaagaaacagagacccctgaagatccgtatgctggatggaactgtgaagacgatcatggtggatgactctaagactgtcactgacatgctcatgaccatctgtgcccgcattggcatcaccaatcatgatgaatattcattggttcgagagctgatggaagagaaaaaggaggaaataacagggaccttaagaaaggacaagacattgctgcgagatgaaaagaagatggagaaactaaagcagaaattgcacacagatgatgagttgaactggctggaccatggtcggacactgagggagcagggtgtagaggagcacgagacgctgctgctgcggaggaagttcttttactcagaccagaatgtggattcccgggaccctgtacagctgaacctcctgtatgtgcaggcacgagatgacatcctgaatggctcccaccctgtctcctttgacaaggcctgtgagtttgctggcttccaatgccagatccagtttgggccccacaatgagcagaagcacaaggctggcttccttgacctgaaggacttcctgcccaaggagtatgtgaagcagaagggagagcgtaagatcttccaggcacacaagaattgtgggcagatgagtgagattgaggccaaggtccgctacgtgaagctagcccgttctctcaagacttacggtgtctccttcttcctggtgaaggaaaaaatgaaagggaagaacaagctagtgcccaggcttctgggcatcaccaaggagtgtgtgatgcgagtggatgagaagaccaaggaagtgatccaggagtggaacctcaccaacatcaaacgctgggctgcgtctcccaaaagcttcaccctggattttggagattaccaagatggctattactcagtacagacaactgaaggggagcagattgcacagctcattgccggctacatcgatatcatcctgaagaagaaaaaaagcaaggatcactttgggctggaaggagatgaggagtctactatgctggaggactcagtgtcccccaaaaagtcaacagtcctgcagcagcaatacaaccgggtggggaaagtggagcatggctctgtggccctgcctgccatcatgcgctctggagcctctggtcctgagaatttccaggtgggcagcatgccccctgcccagcagcagattaccagcggccagatgcaccgaggacacatgcctcctctgacttcagcccagcaggcactcactggaaccattaactccagcatgcaggccgtgcaggctgcccaggccaccctggatgactttgacactctgccgcctcttggccaggatgctgcctctaaggcctggcgtaaaaacaagatggatgaatcaaagcatgagatccactctcaggtagatgccatcacagctggtactgcgtctgtggtgaacctgacagcaggggaccctgctgagacagactataccgcagtgggctgtgcagtcaccacaatctcctccaacctgacggagatgtcccgtggggtgaagctgctggctgccttgctggaggacgaaggcggcagtggtcggcccctgttgcaggcagcaaagggccttgcgggagcagtgtcagaactgctgcgcagtgcccaaccagccagtgctgagccccgtcagaacctgctgcaagcagctgggaacgtgggccaggccagtggggagctgttgcaacaaattggggaaagtgatactgacccccacttccaggatgcgctaatgcagctcgccaaagctgtggcaagtgctgcagctgccctggtcctcaaggccaagagtgtggcccagcggacagaggactcgggacttcagacccaagttattgctgcagcaacacagtgtgccctatccacttcccaactagtggcctgtactaaggtggtggcacctacaatcagctcacctgtctgccaagagcaactggtggaggctggacgactggtagccaaagccgtggagggctgtgtgtctgcctcccaggcagctacagaggatgggcaactgttgcgaggggtaggagcagcagccacagctgtcacccaggccctaaatgagctgctgcagcatgtgaaagcccatgccacaggggctgggcctgctggccgttatgaccaggctactgacaccatcctaaccgtcactgagaacatctttagctccatgggtgatgctggggagatggtgggacaggcccgcatcctggcccaagccacatctgacctggtcaatgccatcaaggctgatgctgagggggaaagtgatctggagaactcccgcaagctcttaagtgctgccaagatcctagctgatgccacagccaagatggtagaggctgccaagggagcagctgcccaccctgacagtgaggagcagcagcagcggctgcgggaggcagctgaggggctgcgcatggccaccaatgcagctgcgcagaatgccatcaagaaaaagctggtgcagcgcctggagcatgcagccaagcaggctgcagcctcagccacacagaccatcgctgcagctcagcacgcagcctctacccccaaagcctctgccggcccccagcccctgctggtgcagagctgcaaggcagtggcagagcagattccactgctggtgcagggcgtccgaggaagccaagcccagcctgacagccccagcgctcagcttgccctcattgctgccagccagagcttcctgcagccaggtgggaagatggtggcagctgcaaaggcctcagtgccaacgattcaggaccaggcttcagccatgcagctgagtcagtgtgccaagaacctgggcaccgcgctggctgaactccggacggctgcccagaaggctcaggaagcatgtggacctttggagatggattctgcactgagtgtggtacagaatctagagaaagatctacaggaagtgaaggcagcagctcgagatggcaagcttaaacccttacctggggagacaatggagaagtgtacccaggacctgggcaacagcaccaaagccgtgagctcagccatcgcccagctactgggagaggttgcccagggcaatgagaattatgcaggtattgcagctcgggatgtggcaggtgggctgcggtcactggcccaggccgctaggggagtcgctgcactgacgtcagatcctgcagtgcaggccattgtacttgatacggccagtgatgtgctggacaaggccagcagcctcattgaggaggcgaaaaaggcagctggccatccaggggaccctgagagccagcagcggcttgcccaggtggctaaagcagtgacccaggctctgaaccgctgtgtcagctgcctacctggccagcgcgatgtggataatgccctgagggcagttggagatgccagcaagcgactcctgagtgactcgcttcctcctagcactgggacatttcaagaagctcagagccggttgaatgaagctgctgctgggctgaatcaggcagccacagaactggtgcaggcctctcggggaacccctcaggacctggctcgagcctcaggccgatttggacaggacttcagcaccttcctggaagctggtgtggagatggcaggccaggctccgagccaggaggaccgagcccaagttgtgtccaacttgaagggcatctccatgtcttcaagcaaacttcttctggctgccaaggccctgtccacggaccctgctgcccctaacctcaagagtcagctggctgcagctgccagggcagtaactgacagcatcaatcagctcatcactatgtgcacccagcaggcacccggccagaaggagtgtgataacgccctgcgggaattggagacggtccgggaactcctggagaacccagtccagcccatcaatgacatgtcctactttggttgcctggacagtgtaatggagaactcaaaggtgctgggcgaggccatgactggcatctcccaaaatgccaagaacggaaacctgccagagtttggagatgccatttccacagcctcaaaggcactttgtggcttcaccgaggcagctgcacaggctgcatatctggttggtgtctctgaccccaatagccaagctggacagcaagggctagtggagcccacacagtttgcccgtgcaaaccaggcaattcagatggcctgccagagtttgggagagcctggctgtacccaggcccaggtgctctctgcagccaccattgtggctaaacacacctctgcactgtgtaacagctgtcgcctggcttctgcccgtaccaccaatcctactgccaagcgccagtttgtacagtcagccaaggaggtggccaacagcacagctaatcttgtcaagaccatcaaggcgctagatggggccttcacagaggagaaccgtgcccagtgccgagcagcaacagcccctctgctggaggctgtggacaatctgagtgcctttgcgtccaaccctgagttctccagcattcctgcccagatcagccctgagggtcgggctgccatggagcccattgtgatctctgccaagacaatgttagagagtgccgggggactcatccagacagcccgggccctcgcagtcaatccccgggaccccccgagctggtcggtgctggccggccactcccgtactgtctcagactccatcaagaagctaattacaagcatgagggacaaggctccagggcagctggagtgtgaaacggccattgcagctctgaacagttgtctacgggacctagaccaggcttccctcgctgcagtcagccagcagcttgctccccgtgagggaatctctcaagaggccttgcacactcagatgctcactgcagtccaagagatctcccatctcattgagccgctggccaatgctgcccgggctgaagcctcccagctgggacacaaggtgtcccagatggcgcagtactttgagccgctcaccctggctgcagtgggtgctgcctccaagaccctgagccacccgcagcagatggcactcctggaccagactaaaacattggcagagtctgccctgcagttgctatacactgccaaggaggctggtggtaacccaaagcaagcagctcacacccaggaagccctggaggaggctgtgcagatgatgaccgaggccgtagaggacctgacaacaaccctcaacgaggcagccagtgctgctggggtcgtgggtggcatggtggactccatcacccaggccatcaaccagctagatgaaggaccaatgggtgaaccagaaggttccttcgtggattaccaaacaactatggtgcggacagccaaggccattgcagtgaccgttcaggagatggttaccaagtcaaacaccagcccagaggagctgggccctcttgctaaccagctgaccagtgactatggccgtctggcctcggaggccaagcctgcagcggtggctgctgaaaatgaagagataggttcccatatcaaacaccgggtacaggagctgggccatggctgtgccgctctggtcaccaaggcaggcgccctgcagtgcagccccagtgatgcctacaccaagaaggagctcatagagtgtgcccggagagtctctgagaaggtctcccacgtcctggctgcgctccaggctgggaatcgtggcacccaggcctgcatcacagcagccagcgctgtgtctggtatcattgctgacctcgacaccaccatcatgttcgccactgctggcacgctcaatcgtgagggtactgaaactttcgctgaccaccgggagggcatcctgaagactgcgaaggtgctggtggaggacaccaaggtcctggtgcaaaacgcagctgggagccaggagaagttggcgcaggctgcccagtcctccgtggcgaccatcacccgcctcgctgatgtggtcaagctgggtgcagccagcctgggagctgaggaccctgagacccaggtggtactaatcaacgcagtgaaagatgtagccaaagccctgggagacctcatcagtgcaacgaaggctgcagctggcaaagttggagatgaccctgctgtgtggcagctaaagaactctgccaaggtgatggtgaccaatgtgacatcattgcttaagacagtaaaagccgtggaagatgaggccaccaaaggcactcgggccctggaggcaaccacagaacacatacggcaggagctggcggttttctgttccccagagccacctgccaagacctctaccccagaagacttcatccgaatgaccaagggtatcaccatggcaaccgccaaggccgttgctgctggcaattcctgtcgccaggaagatgtcattgccacagccaatctgagccgccgtgctattgcagatatgcttcgggcttgcaaggaagcagcttaccacccagaagtggcccctgatgtgcggcttcgagccctgcactatggccgggagtgtgccaatggctacctggaactgctggaccatgtactgctgaccctgcagaagccaagcccagaactgaagcagcagttgacaggacattcaaagcgtgtggctggttccgtcactgagctcatccaggctgctgaagccatgaagggaacagaatgggtagacccagaggaccccacagtcattgctgagaatgagctcctgggagctgcagccgccattgaggctgcagccaaaaagctagagcagctgaagccccgggccaaacccaaggaggcagatgagtccttgaactttgaggagcagatactagaagctgccaagtccattgcagcagccaccagtgcactggtaaaggctgcgtcggctgcccagagagaactagtggcccaagggaaggtgggtgccattccagccaatgcactggacgatgggcagtggtcccagggcctcatttctgctgcccggatggtggctgcggccaccaacaatctgtgtgaggcagccaatgcagctgtacaaggccatgccagccaggagaagctcatctcatcagccaagcaggtagctgcctccacagcccagctccttgtggcctgcaaggtcaaggctgaccaggactcggaggcaatgaaacgacttcaggctgctggcaacgcagtgaagcgagcctcagataatctggtgaaagcagcacagaaggctgcagcctttgaagagcaggagaatgagacagtggtggtgaaagagaagatggttggcggcattgcccagatcatcgcagcacaggaagaaatgcttcggaaggaacgagagctggaagaggcgcggaagaaactggcccagatccggcagcagcagtacaagtttctgccttcagagcttcgagatgagcactaaagaagcctcttctatttaatgcagacccggcccagagactgtgcgtgccactaccaaagccttctgggctgtcggggcccaacctgcccaaccccagcactccccaaagtgcctgccaaaccccagggcctggccccgcccagtcccgcagtacatcccctgtcccctccccaaccccaagtgccttcatgccctagggccccccaagtgcctgcccctccccagagtattaacgctccaagagtattattaacgctgctgtacctcgatctgaatctgccggggccccagcccactccaccctgccagcagcttccagccagtccccacagcctcatcagctctcttcaccgttttttgatactatcttcccccacccccagctacccataggggctgcagagttataagccccaaacaggtcatgctccaataaaaatgattctacctacaaaaaaaaaaaaaaaaaaa

SEQ ID NO: 137 - DNA, 1868 bp, Homo sapiens
ggaagcgagggtgcggcgcaatccggagaggacgccaggacgacgcccgagttccctttcaggctagaactcttcctttttctagcttggggtagaaggcggagccggagccccggaacccccgccctcggggtgcgaggcggcagcagggccgtcccctacatttgcatagcccctgggacgtggcgctgcacccaagcctcttctcagttggagggaactccaagtcccacagtgccacggggtggggtgcgtcactttcgctgcgttggaggctgaggagaattgagcctgggaggcgggtccggagagggctatggaaagccgccggcggggaatcccggccgtagagggacagtggataggtgcccgaggcctacagctggcctggggctcgtgtctgggcttcggacgttggggcccggtggcccaccctttccgtagttgtcccaaatggagctggaattggatgctggtgaccaagacctgctggccttcctgctagaggaaagtggagatttggggacggcacccgatgaggccgtgagggccccactggactgggcgctgccgctttctgaggtaccgagcgactgggaagtagatgatttgctgtgctccctgctgagtcccccagcgtcgttgaacattctcagctcctccaacccctgccttgtccaccatgaccacacctactccctcccacgggaaactgtctctatggatctagagagtgagagctgtagaaaagaggggacccagatgactccacagcatatggaggagctggcagagcaggagattgctaggctagtactgacagatgaggagaagagtctattggagaaggaggggcttattctgcctgagacacttcctctcactaagacagaggaacaaattctgaaacgtgtgcggaggaagattcgaaataaaagatctgctcaagagagccgcaggaaaaagaaggtgtatgttgggggtttagagagcagggtcttgaaatacacagcccagaatatggagcttcagaacaaagtacagcttctggaggaacagaatttgtcccttctagatcaactgaggaaactccaggccatggtgattgagatatcaaacaaaaccagcagcagcagcacctgcatcttggtcctactagtctccttctgcctcctccttgtacctgctatgtactcctctgacacaagggggagcctgccagctgagcatggagtgttgtcccgccagcttcgtgccctccccagtgaggacccttaccagctggagctgcctgccctgcagtcagaagtgccgaaagacagcacacaccagtggttggacggctcagactgtgtactccaggcccctggcaacacttcctgcctgctgcattacatgcctcaggctcccagtgcagagcctcccctggagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtggggggtctcagcaggagcctggggggctccccatctgtgtccaaataaaaagcggtgggcaagggctggccgcagctcctgtgccctgtcaggacgactgagggctcaaacacaccacacttaatggctttctgggtcttttatttgtacccatgtgtctgtcacaccatgaatgtacctggggaaatcaactgacctccctgaacatttcacgcagtcagggaacaggtgaggaaagaaataaataagtgattctaatgctgcctaaaaaaaaaaaaaaaaaa

SEQ ID NO: 138 - DNA, 1534 bp, Homo sapiens
cgccgccgccgccgccgcgtacctagccaggtccctgaggggcgggcagatgaggcctaggggtgccgatccctagtgtcgactatgcgagatctgattccggagctgccatgattgaagtggtagcagagctcagccggggtcctgtatttttggctggggaggcgctggagtgtgtagtgaccgtcaccaacccccttccgcccacggccacttctgcatccagtgaggccctggcctgggccagtgcccaaatccactgccagttccatgccagtgagagtcgagtagcactgcctcctcctgactctagtcagccagatgtccagcccgacagccagactgtctttctgccacaccgaggtgagaggggccagtgtatcctttctactccaccgaaaattctattctgtgacctgaggcttgatcctggagagtccaaatcatactcctacagtgaagtgctgcccatagagggaccaccctcctttcggggtcagtcagtcaagtacgtctacaaactgaccattggctgccagcgtgtcaactcccctatcactttactcagagtccctctgagggttcttgtgctgactggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccatctatacaatatcagtgatggccgagggaaagttgggacgtttggcatcttcaaatctgtgtacagacttggcgaggacgtggtggggaccttaaacttaggggaaggaaccgtagcttgtttgcagttttcagtcagcttacagaccgaggagcgtgtacagcctgagtaccagcggcgacgtggggcagggggtgtcccctctgtgtcacatgtgactcacgcccggcaccaggaatcctgcctacatacaactagaaccagcttctccctcccaatccctctcagctccaccccaggcttctgtacagccattgtgtccttgaagtggagattgcattttgaatttgtaacgtcccgagaaccaggattggtactcctaccccctgtggaacagcccgaacctaccacctggacaggacctgagcaagtacctgtagacaccttcagctgggacctgcccatcaagctggaggaagcctgggtattttgacacgggatcatctgtaaggccccatcctccctgtgccctctctgctgctcctccattcctaacgcttcaccccactttaccttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctcc

SEQ ID NO: 139 - DNA, 3482 bp, Homo sapiens
atggcgctgccatcacttctgctgttggtggcagccctggcaggtggggtgcgtcctcccggggcgcggaacctgacgctggcggtggtgctgccagaacacaacctgagctatgcctgggcctggccacgggtgggacccgctgtggcactagctgtggaggctctgggccgggcactgcccgtggacctgcggtttgtcagctccgaactggaaggcgcctgctctgagtacctggcaccgctgagcgctgtggacctcaagctgtaccatgaccccgacctgctgttaggtcccggttgcgtgtaccctgctgcctctgtggcccgctttgcctcccactggcgccttcccctgctgactgcgggtgctgtggcctctggtttttcggctaagaatgaccattatcgtaccctggttcgcactggcccctctgctcccaagctgggtgagtttgtggtgacactacacgggcacttcaattggactgcccgtgctgccttgctgtacctggatgctcgcacagatgaccggcctcactacttcaccatcgagggcgtctttgaggccctgcagggcagcaacctcagtgtgcagcaccaggtgtatgcccgagagccagggggccccgagcaggccacccacttcatccgggccaacgggcgcattgtgtatatctgcggccctctggagatgctgcatgagatcctgcttcaggcccagagggagaatctgaccaatggggattatgtcttcttttacctggatgtctttggggagagtctccgtgcaggccccacacgtgctacaggccggccctggcaggacaatcgcacccgggaacaggcccaggccctcagagaggcctttcagactgtattggtgatcacgtaccgagaacccccaaatcctgagtatcaggaattccagaatcgtctgctgataagagcccgggaagactttggtgtggagctgggcccttccctgatgaacctcatcgctggctgcttctatgatgggatcctgctatatgctgaagtcctgaatgagacaatacaggaaggaggcacccgggaggatggacttcgaattgtggaaaagatgcagggacgaagatatcacggtgtaactgggctggttgtcatggacaagaacaatgaccgagagactgactttgtcctctgggccatgggagacctggattctggggactttcagcctgcagcccactactcgggagctgagaagcagatttggtggacgggacggcctattccctgggtgaagggggctcctccctcggacaatcccccctgtgcctttgacttggacgacccatcctgtgataaaactccactttcaaccctggcaattgtggctctgggcacaggaatcaccttcatcatgtttggtgtttccagcttcctaattttccgaaagctgatgctggagaaggagctggctagcatgttgtggcgtattcgctgggaagaactgcagtttggcaactcagagcgttatcacaaaggtgcaggcagtcgcctcacactgtcgctgcggggatccagttacggctcgctcatgacagcccatgggaaataccagatctttgccaacaccggtcacttcaagggaaatgttgtcgccatcaaacatgtgaataagaagcgcattgagctgacccggcaggttctgtttgaactcaaacatatgagagatgttcagttcaaccatctcactcgcttcattggcgcctgcatagaccctcccaacatttgcattgtcactgaatactgtcctcgtgggagtttacaggatattctagaaaatgacagcatcaacttggactggatgtttcgttattcactcattaatgaccttgttaagggcatggcctttctccacaacagcattatttcatcgcatgggagtctcaagtcctccaactgtgtggtggatagtcgttttgtgctcaaaatcacagactatggcctggccagcttccgatcaactgctgaacctgatgacagccatgccctctatgccaagaagctgtggactgccccagaactgctcagtgggaaccccttgccaaccacaggcatgcagaaggctgacgtctatagctttgggatcatcctgcaggagatagcacttcgcagtggtcctttctacttggagggcctggacctcagccccaaagagattgtccagaaggtacgaaatggtcagcggccatatttccggccaagcattgaccggacccaactgaatgaagagctagttttgctgatggagcgatgttgggctcaggacccagctgagcggccagactttggacagattaagggcttcattcggcgctttaacaaggagggtggcaccagcatattggacaacctcctgctgcgcatggaacagtatgccaataacttggagaagctggtggaggaacgcacacaggcctatctggaggaaaaacgcaaggctgaagctctgctctaccaaatcctaccccattcagtggcagagcagttaaaacggggagagactgtacaggctgaggcctttgacagtgttaccatctacttcagtgacattgttggcttcacagcattgtcagcagagagcacccccatgcaggtagtgacacttcttaatgacctgtatacctgctttgatgccataattgacaactttgatgtctacaaggtggagacgattggggatgcttacatggtggtatctggcctcccaggccgaaatggtcaacgccatgcaccagaaattgctcgtatggccctagcattactagatgcagtttcttcctttcgcatccgccaccgaccccatgaccagctgaggctacgcataggggtccatactggtaaggctgactctcactccagccctagtctccacctttcccagactctcccaacctgtttcttctcaaagggccagtctgtgctggggttgttggcctgaagatgccccgttattgtctttttggagacacagtgaacactgcttctcgaatggagtctaatggtcaagcgctgaagatccatgtctcctctaccaccaaggatgccctagatgagctaggatgcttccagctagagcttcggggggatgtggaaatgaagggaaaaggaaagatgcgaacatactggctcttaggagagcggaaaggacctcctggactcctgtaaacccccattctttccaagtcagatagtcttctgctgctggtacctgggtgggcaatggccaccatgtctgcacacaccagaaatggacattttcatatgcaatggaaaacagccacaaaaagacctaccttatatggaagttgtagccctctgcagctcagccctgtacatatacctgtccctctctggcttggtccccttcctccctactttctgtaaatatctgtatctaaaccagaatattttggtcaaatataaaacaataat

SEQ ID NO: 140 - DNA, 3411 bp, Homo sapiens
atggcgctgccatcacttctgctgttggtggcagccctggcaggtggggtgcgtcctcccggggcgcggaacctgacgctggcggtggtgctgccagaacacaacctgagctatgcctgggcctggccacgggtgggacccgctgtggcactagctgtggaggctctgggccgggcactgcccgtggacctgcggtttgtcagctccgaactggaaggcgcctgctctgagtacctggcaccgctgagcgctgtggacctcaagctgtaccatgaccccgacctgctgttaggtcccggttgcgtgtaccctgctgcctctgtggcccgctttgcctcccactggcgccttcccctgctgactgcgggtgctgtggcctctggtttttcggctaagaatgaccattatcgtaccctggttcgcactggcccctctgctcccaagctgggtgagtttgtggtgacactacacgggcacttcaattggactgcccgtgctgccttgctgtacctggatgctcgcacagatgaccggcctcactacttcaccatcgagggcgtctttgaggccctgcagggcagcaacctcagtgtgcagcaccaggtgtatgcccgagagccagggggccccgagcaggccacccacttcatccgggccaacgggcgcattgtgtatatctgcggccctctggagatgctgcatgagatcctgcttcaggcccagagggagaatctgaccaatggggattatgtcttcttttacctggatgtctttggggagagtctccgtgcaggccccacacgtgctacaggccggccctggcaggacaatcgcacccgggaacaggcccaggccctcagagaggcctttcagactgtattggtgatcacgtaccgagaacccccaaatcctgagtatcaggaattccagaatcgtctgctgataagagcccgggaagactttggtgtggagctgggcccttccctgatgaacctcatcgctggctgcttctatgatgggatcctgctatatgctgaagtcctgaatgagacaatacaggaaggaggcacccgggaggatggacttcgaattgtggaaaagatgcagggacgaagatatcacggtgtaactgggctggttgtcatggacaagaacaatgaccgagagactgactttgtcctctgggccatgggagacctggattctggggactttcagcctgcagcccactactcgggagctgagaagcagatttggtggacgggacggcctattccctgggtgaagggggctcctccctcggacaatcccccctgtgcctttgacttggacgacccatcctgtgataaaactccactttcaaccctggcaattgtggctctgggcacaggaatcaccttcatcatgtttggtgtttccagcttcctaattttccgaaagctgatgctggagaaggagctggctagcatgttgtggcgtattcgctgggaagaactgcagtttggcaactcagagcgttatcacaaaggtgcaggcagtcgcctcacactgtcgctgcggggatccagttacggctcgctcatgacagcccatgggaaataccagatctttgccaacaccggtcacttcaagggaaatgttgtcgccatcaaacatgtgaataagaagcgcattgagctgacccggcaggttctgtttgaactcaaacatatgagagatgttcagttcaaccatctcactcgcttcattggcgcctgcatagaccctcccaacatttgcattgtcactgaatactgtcctcgtgggagtttacaggatattctagaaaatgacagcatcaacttggactggatgtttcgttattcactcattaatgaccttgttaagggcatggcctttctccacaacagcattatttcatcgcatgggagtctcaagtcctccaactgtgtggtggatagtcgttttgtgctcaaaatcacagactatggcctggccagcttccgatcaactgctgaacctgatgacagccatgccctctatgccaagaagctgtggactgccccagaactgctcagtgggaaccccttgccaaccacaggcatgcagaaggctgacgtctatagctttgggatcatcctgcaggagatagcacttcgcagtggtcctttctacttggagggcctggacctcagccccaaagagattgtccagaaggtacgaaatggtcagcggccatatttccggccaagcattgaccggacccaactgaatgaagagctagttttgctgatggagcgatgttgggctcaggacccagctgagcggccagactttggacagattaagggcttcattcggcgctttaacaaggagggtggcaccagcatattggacaacctcctgctgcgcatggaacagtatgccaataacttggagaagctggtggaggaacgcacacaggcctatctggaggaaaaacgcaaggctgaagctctgctctaccaaatcctaccccattcagtggcagagcagttaaaacggggagagactgtacaggctgaggcctttgacagtgttaccatctacttcagtgacattgttggcttcacagcattgtcagcagagagcacccccatgcaggtagtgacacttcttaatgacctgtatacctgctttgatgccataattgacaactttgatgtctacaaggtggagacgattggggatgcttacatggtggtatctggcctcccaggccgaaatggtcaacgccatgcaccagaaattgctcgtatggccctagcattactagatgcagtttcttcctttcgcatccgccaccgaccccatgaccagctgaggctacgcataggggtccatactgggccagtctgtgctggggttgttggcctgaagatgccccgttattgtctttttggagacacagtgaacactgcttctcgaatggagtctaatggtcaagcgctgaagatccatgtctcctctaccaccaaggatgccctagatgagctaggatgcttccagctagagcttcggggggatgtggaaatgaagggaaaaggaaagatgcgaacatactggctcttaggagagcggaaaggacctcctggactcctgtaaacccccattctttccaagtcagatagtcttctgctgctggtacctgggtgggcaatggccaccatgtctgcacacaccagaaatggacattttcatatgcaatggaaaacagccacaaaaagacctaccttatatggaagttgtagccctctgcagctcagccctgtacatatacctgtccctctctggcttggtccccttcctccctactttctgtaaatatctgtatctaaaccagaatattttggtcaaatataaaacaataat

SEQ ID NO: 141 - DNA, 2134 bp, Homo sapiens
gcacgagcgccggttcagcgcagcccggagtcgcccaggcctgaactcctacccaggtccccggcccccgccccgggcccgcgaggacaccggaggccaccccccgggggtggggagcggagccgcggcctagactcaagtctgggtttcagctgccgccagccctattgctgctgttgctgttctctgtccttggcccaggggctggaggccttttcctgactgattactccacctgctcaccccgcaagctgagtcctttccgctcctttgccagcaccgagctcttccacttccatgttcctgaggacacattcctggctgtttggaacctcatcatcttcaaggagcaagggggaacttttggggaccactgcccagaccaaagtgtgactgtgtatttccggtccggggcaccccctgtcatcaatcccctgcatacacacttcccaggggacacagctgtgcctggggttttctcactgaccctcagctggacactgcccaaccgcacctcaggcatctttaacgtcagcagccccttacctggggactggttcttggctgcccaccttccccaggcccacggccacatctctgtcaagggtctccaggatgagtgtcagtacctccttcagccgcagctgattgtccggcgtttgctggacgtcgctgtgctggttcctggccggccctcagagcaaaccctctccccacacaatcgctcagccctgtacaaggtctttgtgcccagcttcacttacagggtttcagcacagctggtgtgtgtggggggccgtggggtatctgcctgccccctgtcactgcgtctgcgtcccaaagccccacccctgcacaactcaagctctgtggcctgtggaggtgcctcaggatgccagctggagctggcactgcccccctgggggcactgggtctacgtgcgtgtggaaacatcatcccggggccctggtaggaccatccgcttccagctgtgtgtgcagttgcaagagtgcccacagcccggcctgctccgagccctggtccctggagctgccatgaacatgccccagtccctgggcaaccagccactgcccccagaaccgccatcccttggaacccctgcggaggggcctgggaccacgtccccacccgagcactgctggccagtgcgcccgactctgcgcaacgagctggacaccttctctgtccacttctacatcttctttggcccaagtgtggcccttccccctgagcgcccagccgtgttcgccatgaggctgttgccagtgctggacagtggaggcgtcctcagcctggagctccagctcaatgcgagctccgtgcgccaggaaaacgtgacggtgtttggatgcttgactcacgaggtgcccttgagcctgggggatgcagcagtgacctgttccaaagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacggtatgcggtggtgtctgcatcttatcactgggtgcttgtgcatggtggtgggtcacagtctgtatttccaccacgttctccgagggtttgggaatgtctgtgccttcactgtgtcttctacagacagagacagcagtgcttcccaaactgtcatgcatagataatggtcatttttgtaagacacattggagtaaatgaacaaaactgtttgcaacttaataaagtaagtttgggcctccaaaaaaaaaaaaaaaaaaaaa

SEQ ID NO: 142 - DNA, 1023 bp, Homo sapiens
agcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgt

SEQ ID NO: 143 - DNA, 1105 bp, Homo sapiens
gccaccgctgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggtggcagatgaagctttctacaaacaacccttcgctgacgtgattggttatgtcacaaacataaaccatccttgctacagcctagaacaggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgt

SEQ ID NO: 144 - DNA, 1023 bp, Homo sapiens; identical to SEQ ID NO: 142

SEQ ID NO: 145 - DNA, 1105 bp, Homo sapiens; identical to SEQ ID NO: 143

SEQ ID NO: 146 - DNA, 4581 bp, Homo sapiens
cggaacccggtcgaaagggtcctctctggcgtccttctgcttccgtgggtttctggataggctgcgttttgttctcaggggatgcaagttcttcctttcagggttgaagcgtgagagaggttggtttttgaaacgggagtgtttcaggttattgaggtccaaaaagaaataaagtttttgtttacgtctgtatggcttgtaagatatctcccggggccaattcagcatctctacctggccatcctaacaaggtgatttgtgaaagggtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaaatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaacatcaaaaaaaaaaaaaaaaaa

SEQ ID NO: 147 - DNA, 4748 bp, Homo sapiens
gcggcggggcgcggcggggcggggaggggcgtggccgggccgggcccctagtgcggtgttgcgggacggggccgaggcccggtcggttggggcgtgggggcggagaggatggagcctccgaggcgttaggcgactctgtcatctctgggcgtgcagccgtcgtttcctggcgcggcccgtgtgatggtgccgggaggaaggaagcgcagtgacagtgcctaagttggagccggggttccgggggtgaggaggcccgcggacggcggatctggcgagctggccgcgggctgggcgagcagtcacaataggaggcggcggcccagcgaggatccgcgggagctgcccggcagggcggagcctcccctcgcagatatctcccggggccaattcagcatctctacctggccatcctaacaaggtgatttgtgaaagggtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaaatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaacatcaaaaaaaaaaaaaaaaaa

SEQ ID NO: 148 - DNA, 4431 bp, Homo sapiens
cggaacccggtcgaaagggtcctctctggcgtccttctgcttccgtgggtttctggataggctgcgttttgttctcaggggatgcaagttcttcctttcagggttgaagcgtgagagaggttggtttttgaaacgggagtgtttcaggttattgaggtccaaaaagaaataaagtttttgtttacgtctgtatggcttgtaagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaaatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaacatcaaaaaaaaaaaaaaaaaa

SEQ ID NO: 149 - DNA, 4479 bp, Homo sapiens
cttccccctcggggtggaaacaaagggggttcggcgcgcggtgcggagcctgggggaaaagggaggagcgctccggtggtctggcgcgctgggctcgctagatatctcccggggccaattcagcatctctacctggccatcctaacaaggtgatttgtgaaagggtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaaatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaacatcaaaaaaaaaaaaaaaaaa

SEQ ID NO: 150 - DNA, 4275 bp, Homo sapiens
cttccccctcggggtggaaacaaagggggttcggcgcgcggtgcggagcctgggggaaaagggaggagcgctccggtggtctggcgcgctgggctcgctagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaaatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaacatcaaaaaaaaaaaaaaaaaa

SEQ ID NO: 151 - DNA, 4598 bp, Homo sapiens
gcggcggggcgcggcggggcggggaggggcgtggccgggccgggcccctagtgcggtgttgcgggacggggccgaggcccggtcggttggggcgtgggggcggagaggatggagcctccgaggcgttaggcgactctgtcatctctgggcgtgcagccgtcgtttcctggcgcggcccgtgtgatggtgccgggaggaaggaagcgcagtgacagtgcctaagttggagccggggttccgggggtgaggaggcccgcggacggcggatctggcgagctggccgcgggctgggcgagcagtcacaataggaggcggcggcccagcgaggatccgcgggagctgcccggcagggcggagcctcccctcgcagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaaatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaacatcaaaaaaaaaaaaaaaaaa

SEQ ID NO: 152 - DNA, 1741 bp, Homo sapiens
gatcgggcggcgccgagctgaggtggtgagggactagctcccggatgtggagaagctggggagaaggcgtgggaggaagatggactcggtggagaagggggccgccacctccgtctccaacccgcgggggcgaccgtcccggggccggccgccgaagctgcagcgcaactctcgcggcggccagggccgaggtgtggagaagcccccgcacctggcagccctaattctggcccggggaggcagcaaaggcatccccctgaagaacattaagcacctggcgggggtcccgctcattggctgggtcctgcgtgcggccctggattcaggggccttccagagtgtatgggtttcgacagaccatgatgaaattgagaatgtggccaaacaatttggtgcacaagttcatcgaagaagttctgaagtttcaaaagacagctctacctcactagatgccatcatagaatttcttaattatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggctcattttattttgctaaaagacatttgatagagatgggttacttgcagggtggaaaaatggcatactacgaaatgcgagctgaacatagtgtggatatagatgtggatattgattggcctattgcagagcaaagagtattaagatatggctattttggcaaagagaagcttaaggaaataaaacttttggtttgcaatattgatggatgtctcaccaatggccacatttatgtatcaggagaccaaaaagaaataatatcttatgatgtaaaagatgctattgggataagtttattaaagaaaagtggtattgaggtgaggctaatctcagaaagggcctgttcaaagcagacgctgtcttctttaaaactggattgcaaaatggaagtcagtgtatcagacaagctagcagttgtagatgaatggagaaaagaaatgggcctgtgctggaaagaagtggcatatcttggaaatgaagtgtctgatgaagagtgcttgaagagagtgggcctaagtggcgctcctgctgatgcctgttctactgcccagaaggctgttggatacatttgcaaatgtaatggtggccgtggtgccatccgagaatttgcagagcacatttgcctactaatggaaaaggttaataattcatgccaaaaatagaaattagcgtaatattgagaaaaaaatgatacagccttcttcagccagtttgcttttatttttgattaagtaaattccatgttgtaatgttacagagagtgtgatttggtttgtgatatatatatattgtgctctacttttctctttacgcaagataattatttagagactgattacagtctttctcagatttttagtaaatgcaagtaagaacatcatcaaagttcactttgtattgtaccctgtaaaactgtgtgtttgtgtgctttcaaagatgttgggattttatttatctggggacagtgtgtatggtaagacatgcccttctattaataaaactacatttctcaaacttga

SEQ ID NO: 153 - DNA, 5468 bp, Homo sapiens
cgcccgcccagccccgggggcagggaaagcctaaattacggaattaccgcgagcaaggagcgcggaatcggggagcgtccggagctagctggatcctctaggcaggatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatcttagataatgctgatgttctgagtcagtaccaactgaattctatccaaaagaaccacgttcatattgcaaacccagattttatatggaaatctatcagagaaaagagactcttggatgtaaagaattatgatccttataagcccctggacatcacaccacctcctgatcagaaggcgagcagttctgaagtgaaaacagaaggtctatgcccggacagtgccacagaggaggaagacactgtggaactcactgagtttggtatgcagaatgttgaaattcctcatcttcctcaagattttgaagttgcaaaatataacaccttggagaaagtgggaatggagggaggccaggaagctgtggtggtggagcttcagtgttcgcgggactccagggactgtcctttcctgatatcctcacacttcctcctggatgatggcatggagactagaagacagtttgctataaagaaaacctctgaagatgcaagtgaatactttgaaaattacattgaagaactgaagaaacaaggatttctactaagagaacatttcacacctgaagcaacccaattagcatctgaacaattgcaagcattgcttttggaggaagtcatgaattcaagcactctgagccaagaggtgagcgatttagtagagatgatttgggcagaggccctgggccacctggaacacatgcttctcaagccagtgaacaggattagcctcaacgatgtgagcaaggcagaggggattctccttctagtaaaggcagcactgaaaaatggagaaacagcagagcaattgcaaaagatgatgacagagttttacagactgatacctcacaaaggcacaatgcccaaagaagtgaacctgggactattggctaagaaagcagacctctgccagctaataagagacatggttaatgtctgtgaaactaatttgtccaaacccaacccaccatccctggccaaataccgagctttgaggtgcaaaattgagcatgttgaacagaatactgaagaatttctcagggttagaaaagaggttttgcagaatcatcacagtaagagcccagtggatgtcttgcagatatttagagttggcagagtgaatgaaaccacagagtttttgagcaaacttggtaatgtgaggcccttgttgcatggttctcctgtacaaaacatcgtgggaatcttgtgtcgagggttgcttttacccaaagtagtggaagatcgtggtgtgcaaagaacagacgtcggaaaccttggaagtgggatttatttcagtgattcgctcagtacaagtatcaagtactcacacccgggagagacagatggcaccagactcctgctcatttgtgacgtagccctcggaaagtgtatggacttacatgagaaggacttttccttaactgaagcaccaccaggctacgacagtgtgcatggagtttcacaaacagcctctgtcaccacagactttgaggatgatgaatttgttgtctataaaaccaatcaggttaaaatgaaatatattattaaattttccatgcctggagatcagataaaggactttcatcctagtgatcatactgaattagaggaatacagacctgagttttcaaatttttcaaaggttgaagattaccagttaccagatgccaaaacttccagcagcaccaaggccggcctccaggatgcttctgggaacttggttcctctggaggatgtccacatcaaagggagaatcatagacactgtagcccaggtcattgtttttcagacatacacaaataaaagtcacgtgcccattgaggcaaaatatatctttcctttggatgacaaggccgctgtgtgtggcttcgaagccttcatcaatgggaagcacatagttggagagattaaagagaaggaagaagcccagcaagagtacctagaagccgtgacccagggccatggcgcttacctgatgagtcaggatgctccggacgtttttactgtaagtgttggaaacttaccccctaaggctaaggttcttataaaaattacctacatcacagaactcagcatcctgggcactgttggtgtctttttcatgcccgccaccgtagcaccctggcaacaggacaaggctttgaatgaaaaccttcaggatacagtagagaagatttgtataaaagaaataggaacaaagcaaagcttctctttgactatgtctattgagatgccgtacgtgattgaattcattttcagtgatactcatgaactgaaacaaaagcgcacagactgcaaagctgtcattagcaccatggaaggcagctccttagacagcagtggattttctctccacatcggtttgtctgctgcctatctcccaagaatgtgggttgaaaaacatccagaaaaagaaagcgaggcttgcatgcttgtctttcaacccgatctcgatgtcgacctccctgacctagccaatgagagcgaagtgattatttgtcttgactgctccagttccatggagggtgtgacattcttgcaagccaaggaaatcgccttgcatgcgctgtccttggtgggtgagaagcagaaagtaaatattatccagttcggcacaggttacaaggagctattttcgtatcctaagcatatcacaagcaataccgcggcagcagagttcatcatgtctgccacacctaccatggggaacacagacttctggaaaacactccgatatcttagcttattgtaccctgctcgagggtcacggaacatcctcctggtgtctgatgggcacctccaggatgagagcctgacattacagctcgtgaagaggagccgcccgcacaccaggttattcgcctgcggtatcggttctacagcaaatcgtcacgtcttaaggattttgtcccagtgtggtgccggagtatttgaatattttaatgcaaaatccaagcatagttggagaaaacagatagaagaccaaatgaccaggctatgttctccgagttgccactctgtctccgtcaaatggcagcaactcaatccagatgcgcccgaggccctgcaggccccagcccaggtgccatccttgtttcgcaatgatcgactccttgtctatggattcattcctcactgcacacaggcaactctgtgtgcactaattcaagagaaagaattttgtacaatggtgtcgactactgagcttcagaagacaactggaactatgatccacaagctggcagcccgagctctaatcagagattatgaagatggcattcttcacgaaaatgaaaccagtcatgagatgaaaaaacaaaccttgaaatctctgattattaaactcagtaaagaaaactctctcataacacaatttacaagctttgtggcagttgagaaaagggatgagaatgagtcaccttttcctgatattccaaaagtttctgaacttattgccaaagaagatgtagacttcctgccctacatgagctggcagggggaaccccaagaagccgtcaggaaccagtctcttttagcatcctctgagtggccagaattacgtttatccaaacgaaaacataggaaaattccattttccaaaagaaaaatggaattatctcagccagaagtttctgaagattttgaagaggatgccttaggtgtactaccagctttcacatcaaatttggaacgtggacgtgtggaaaagctattggatttaagttggacagagtcatgtaaaccaacagcaactgaaccactatttaagaaagtcagtccatgggaaacatctacttctagcttttttcctattttggctccggccgttggttcctatcttaccccgactacccgcgctcacagtcctgcttccttgtcttttgcctcatatcgtcaggtagctagtttcggttcagctgctcctcccagacagtttgatgcatctcaattcagccaaggccctgtgcctggcacttgtgctgactggatcccacagtcggcgtcttgtcccacaggacctccccagaacccaccttctgcaccctattgtggcattgttttttcagggagctcattaagctctgcacagtctgctccactgcaacatcctggaggctttactaccaggccttctgctggcaccttccctgagctggattctccccagcttcatttctctcttcctacagaccctgatcccatcagaggttttgggtcttatcatccctctgcttactctccttttcattttcaaccttccgcagcctctttgactgccaaccttaggctgccaatggcctctgctttacctgaggctctttgcagtcagtcccggactaccccagtagatctctgtcttctagaagaatcagtaggcagtctcgaaggaagtcgatgtcctgtctttgcttttcaaagttctgacacagaaagtgatgagctatcagaagtacttcaagacagctgctttttacaaataaaatgtgatacaaaagatgacagtatcccgtgctttctggaagtaaaagaagaggatgaaatagtgtgcacacaacactggcaggatgctgtgccttggacagaactcctcagtctacagacagaggatggcttctggaaacttacaccagaactgggacttatattaaatcttaatacaaatggtttgcacagctttcttaaacaaaaaggcattcaatctctaggtgtaaaaggaagagaatgtctcctggacctaattgccacaatgctggtactacagtttattcgcaccaggttggaaaaagagggaatagtgttcaaatcactgatgaaaatggatgacccttctatttccaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaagtcaaatgaaactgaattttaaactttttgcatgcttctatgtagaaaataatcaaatgataatagatacttataatgaaacttcattaaggtttcattcagtgtagcaattactgtctttaaaaattaagtggaagaagaattactttaatcaactaacaagcaataataaaatgaaacttaaaat

SEQ ID NO: 154 - DNA, 4201 bp, Homo sapiens
cagtaccggcctcctccagcagggggcgctgtgggatccgccgctgtccgggacgaaccagcaagccgctctcggtccacacacgctctgtctgcctgccccgagtcccccgggaggccgcggggtttggggaagtgtttctaggagacggcgctcaccggctgcacctgcgccgttgacgccaccggggccggcagacagacccgcggcgctggctggtggagggagttcccgcttgctctctgtcgctgtcaccgccctgtttctgtagccgtatggtacgcctgtgagaccggctgccggctgacgtctccttgcgatggagcatatccggacgaccaaggtcgaacaagtaaaattacttgaccgattcagtaccagcaacaagtcattaacaggaacactgtatcttacggctacacatctattatttatcgactctcatcaaaaagaaacctggatattacaccaccatattgcctcagtagagaaacttgctttgactacttctggatgcccccttgtgatacagtgcaagaacttcagaactgtgcatttcattgttcccagagaaagagattgccatgatatttacaactctttgctacaactgtcaaaacaagcaaaatatgaagatctctatgcattttcttataatcccaaacaaaatgattcagaacgactacaaggctggcagctcattgatctcgctgaggaatataagaggatgggagtgccaaactcacactggcagttgtctgatgccaaccgggactacaagatttgtgaaacttaccccagagaactttatgttccccggatagcaagcaaaccaataattgttggtagttccaagttccggagcaagggaagattcccagttctttcctactatcatcaagataaggaggctgccatttgtcgatgtagtcagccactctctggattcagtgccaggtgcctggaggatgaacatttgcttcaagccattagtaaagccaatccagtcaatcgctatatgtacgtcatggataccaggccaaaactgaatgcaatggccaacagagcagctggaaaaggttatgaaaatgaagacaactattccaatattagatttcagtttgttggaattgaaaatattcatgtcatgaggtccagccttcagaaattattggaagtcaatggcactaaagggctttctgtcaatgatttctactccggtttggagagctcgggatggcttcgccatatcaaagctgttatggatgctgcagtcttcttggccaaagcaataacagttgaaaatgcaagtgtgttggtgcattgttccgatggttgggataggacttcccaggtttgttccctgggttctcttttattggattcctactacaggacaatcaaaggattcatggttttaatagaaaaggattggatctcttttggacataaattttcagagaggtgtggccagttggatggtgacccaaaggaagtctcaccagtgtttactcagttcttggaatgtgtgtggcatttgaccgaacagtttccacaagcctttgaattcagtgaagcatttcttcttcagatccatgagcatattcattcatgccagtttggaaacttccttggaaattgtcagaaggaaagagaagagctcaagttgaaggagaagacttattccctgtggccatttcttttggaagaccaaaagaagtacttaaatcctctctacagttccgaatctcacagatttacagttttggagccaaatacagtatctttcaattttaagttttggaggaacatgtaccatcaatttgatcgaacactgcatcctaggcagtctgtatttaatataattatgaatatgaatgagcaaaataaacaattagagaaagatattaaagacctagaatctaaaattaaacaacgcaaaaataagcaaacagatggcatcctcaccaaggaattgttacattcagttcatcctgaatcacctaacctcaaaacttccctgtgttttaaagagcagactctgctacccgtaaatgatgctcttcgaactatagagggcagcagcccggcagataatcgttatagtgaatatgcagaagagttttctaaatcagaacctgctgtggtcagcttagagtatggtgtggcaagaatgacttgttagactcatagagttttttctgcaatgattgcagtacaagaaaaggattattgtgaggatggtctgtaagcataaccaaaaggaatttgtctaataacaattttagggtttaacagtaggctaatagttgaaggaaggataataactacccttgtgagagaaataagtcattttaattgcatttccagcaaggaatgacattcagttctgtaagaaatgagtggtatttgatgtatttactcaaaacacaatttgcactgtacactagtgaattgacgtttatgatttatgttaattcagccaaacataaataaccttccttaagtacaatttaacttcaagaaaacaaaatttgacaacatagtttcttaataaatgatatggcatgtactttcaattatgtagctttgtaactatgaatatttacatattttgccttttagtgatatttaatgttaaagtgccatgaaaaatatttctaagaaagccttaaattcccagtggattctttacccttaagttttacagcctacaacaagattttttgttttgtttttcttctggtcagccttgttttgtttgtaaagaattgtgctctcattactgctgggggtgcatgctacaatacttctatataaacacttgtagaagtacactgttcacgtttagcctgccccacttttgtattcaaaattaatgaaactgaaggtttattctgatcataatttgtttagtgctacatttgataatttattatttacagcttagaatattgatttcttgaatacgtataagcacatttgactgtcttttatatatggattactgcattccattgattcttattttgtggttggctttatttctttcacaactgtgtaagtttaaagagctaaagctctaaaactgttctgagaaacaatgaatagtacatgtatatgtatatttttaaactgccttattgctcaatgagttgctgttcctggagtatctaactttcagtttactcaaaaacttttgggtaaataaaaaagggaagtacagatagtttaggttgtgcatggttgcatgaattttgaagtcatttctatgtggagcattatttttcttcttgttaaatatagaaaaaaaaagagattctagtacaaagttactgtttaacaaaagcaacataaactctgggaaagatttcattttgccatgttatatttactgtttattctgtgtactagtacatatctttaaattaccaaaaaacaagaaacaaaacataaaaaccccaaaactatcacttggaattagcaatatcacccaactggctttaaaattgaaaatttaaataacatggtggcatgaagtacaattcgagtattaggcaatttgcatagtgttcctcatgctactttctgttacacctctattatattagttttgaatataaacatctttttcagaccaaaaaaaactttattgtatgagagcttatcttatcctgtttatttttccaatgcttttctgtaatacattatgtaatttaaaaaatattcctttttaaacagcaacagaaatgcactataaaatatagtatgtgattaaccaatcctgcttccatatttaagcactgggaatggaaacttaatctctgtgactacaaagggaagtttttgtgccttggtgttccagtcactgattgtggttttagaatcttctgtggctgacttcttgtattcaactctggtttattatcttaatcttcaacttcagacatatatttgtgtgtttatatgctcacaggtggactgagaaatcagttacatcttaagtgacctacagggtatatgttggcaaaagcagactgtgtatatgtcttataaagttgaatttatgttcagtgtgtttggaagtgtatagcatgtaaattatttcatatatgatttaaaggtaattaaatgttcacattttactttgaatgtttttcttctggataaaacaaatggaatcaaaaaaaaaaaaaaaaaa

SEQ ID NO: 155 - DNA, 3598 bp, Homo sapiens
gcaagagggcggaacgcgggacgccaggcaccctagctcccgacggacgcagttttcagttgcacgggcgagctccgggccggctgcggagcgactccccgccgccaagtgggcggcgtggctgtcgggaaagaagggctggggcctgccgttcttcctcccgagtatcccctccagctggacgaccccacgctgcagcacgggcttccggcttctctcctcagtggccaattcgagggcacagcgggctccggaggcgcggcggcaagcctatcccgcctcccaaccacagcctccagcacccgagagaacggccgcccacagcacacgttctccggacaggagggcgaaggcccaagacctggagagatgggcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggagaaataacatcagaagaactgcaacagcggttagatggcgtcaaggaacaactagcatctcagcctgacttgagagatggaacgaattacagagactcagaagtccctagagaaagttcacatgaagattctcttctagaatggttgaacacctttcggcgcacaggaaatgcaactcgaagtggacaaaatgggaaccaaacttggagagctgtgagtcgaacaaacccgaacaatggagagtttcggtttagtttggaaatccacgtaaatcatgaaaatagaggatttgaaattcatggagaagattatacagacattccactttcagatagtaacagagatcatactgcaaataggcaacaaaggtcaactagtcctgtggctaggcgaacaagaagccaaacctcagtgaatttcaatggtagtagttccaacattccaaggactaggcttgcttcaagggggcaaaatccagctgaaggatctttctcaacattgggaaggttaagaaatggaattgggggagcagctggcattcctcgagctaacgcttcacgcactaatttcagtagtcacacaaaccaatcaggtggtagtgaactcaggcaaagggaggggcaacggtttggagcagcacatgtttgggaaaatggggctagaagtaatgttacagtgaggaatacaaaccaaagattagagccaataagattacgatctacttccaatagtcgaagccgttcaccaattcagagacagagtggcactgtttatcataattcccaaagggaaagtagaccagtacagcaaaccactagaagatctgttaggaggagaggtagaactcgagtctttttagagcaagatagagaacgagaacgcagaggtactgcatataccccattctctaattcaaggcttgtgtcaagaataacagtagaagaaggagaagaatccagcagatcctcaactgctgtacgacgacatccaacaatcacactggaccttcaagtgagaaggatccgtcctggagaaaatagagatcgggatagtattgcaaatagaactcgatccagagtagggctagcagaaaatacagtcactattgaaagcaatagtgggggctttcgccgaaccatttctcgtttagagcggtcaggtattcgaacctatgttagtaccataacagttcctcttcgtaggatttctgagaatgagcttgttgagccatcatcagtggctcttcggtcaattttaaggcagatcatgactgggtttggagaactgagttctctaatggaggccgattctgagtcagaacttcaaagaaatggccagcatttaccagacatgcactcagaactgagtaacttaggtacagataacaacaggagccagcacagggaaggttcctctcaagacaggcaggcccaaggagacagcactgaaatgcatggtgaaaacgagaccacccagcctcatactcgaaacagtgacagtaggggtggcaggcagttgcgaaatccaaacaatttagttgaaactggaacactacccattcttcgccttgctcacttttttttactaaatgaaagtgatgatgatgatcgaatacgtggtttaaccaaagagcagattgacaatctttccaccaggcactatgagcataacagtattgatagtgaactaggtaaaatctgtagtgtttgtattagtgactatgtaactggaaacaagctcaggcaattaccttgcatgcatgaatttcacattcattgtattgaccgatggctctcagagaattgcacttgtccgatctgtcggcagcctgttttagggtctaacatagcaaacaatgggtaaggtgatgggatctactcaaatactgttttttagtagaactgaatgttcaagcattgttttgctgagttatttgtgattagctaaccaggatgaaaaataacagattatatatagtttgaactatttttcgtgtgcttttttaaacttgttaaaaagaaatttatataaaatttaaaatacaaatgttaaattatccagaaatacagaatagttaatattgctagaaccaaataacctctaaaatgtttttattttggtaattttgtcatgctaagcacttttgtatctgcacaattcagtaggttaagaatcaatcttctttttcttaatagtacagcagactttagcttcaagtttcataggcttagtacttatatctagacatttgtgtctaaataagcttttcattaactttttattttaaggacagtatcttttcatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaaagtagagataatttactgaagcgtctctgacaatctaacttattagacagcaagcaatatataatactgaaaaagtattcagaaatggaaaatttacatcatataggttatttaacttgtgttcagcctttttgtaacttttttgaaagtgcaaacaattctttggattattaaataaggtatacagtatgcatggtttctcaaatttagttttaaaatctaaaagtctataaagaatcagatgcataggcaatatgttaagttcacttggaggctaaaaatctccagtgaaaacaaaacgaaaacctttaagagaatgtagagtttatataaacacaaagtatgcattgaagatctgtttctaccaataaacattaaaacaaagactgtaaaaaaaaaaaaaaa

SEQ ID NO: 156 - DNA, 3284 bp, Homo sapiens
cttccttgtgagaatctaggtctctaagggaagcgttacttgaggctcggttgggaagggcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggagaaataacatcagaagaactgcaacagcggttagatggcgtcaaggaacaactagcatctcagcctgacttgagagatggaacgaattacagagactcagaagtccctagagaaagttcacatgaagattctcttctagaatggttgaacacctttcggcgcacaggaaatgcaactcgaagtggacaaaatgggaaccaaacttggagagctgtgagtcgaacaaacccgaacaatggagagtttcggtttagtttggaaatccacgtaaatcatgaaaatagaggatttgaaattcatggagaagattatacagacattccactttcagatagtaacagagatcatactgcaaataggcaacaaaggtcaactagtcctgtggctaggcgaacaagaagccaaacctcagtgaatttcaatggtagtagttccaacattccaaggactaggcttgcttcaagggggcaaaatccagctgaaggatctttctcaacattgggaaggttaagaaatggaattgggggagcagctggcattcctcgagctaacgcttcacgcactaatttcagtagtcacacaaaccaatcaggtggtagtgaactcaggcaaagggaggggcaacggtttggagcagcacatgtttgggaaaatggggctagaagtaatgttacagtgaggaatacaaaccaaagattagagccaataagattacgatctacttccaatagtcgaagccgttcaccaattcagagacagagtggcactgtttatcataattcccaaagggaaagtagaccagtacagcaaaccactagaagatctgttaggaggagaggtagaactcgagtctttttagagcaagatagagaacgagaacgcagaggtactgcatataccccattctctaattcaaggcttgtgtcaagaataacagtagaagaaggagaagaatccagcagatcctcaactgctgtacgacgacatccaacaatcacactggaccttcaagtgagaaggatccgtcctggagaaaatagagatcgggatagtattgcaaatagaactcgatccagagtagggctagcagaaaatacagtcactattgaaagcaatagtgggggctttcgccgaaccatttctcgtttagagcggtcaggtattcgaacctatgttagtaccataacagttcctcttcgtaggatttctgagaatgagcttgttgagccatcatcagtggctcttcggtcaattttaaggcagatcatgactgggtttggagaactgagttctctaatggaggccgattctgagtcagaacttcaaagaaatggccagcatttaccagacatgcactcagaactgagtaacttaggtacagataacaacaggagccagcacagggaaggttcctctcaagacaggcaggcccaaggagacagcactgaaatgcatggtgaaaacgagaccacccagcctcatactcgaaacagtgacagtaggggtggcaggcagttgcgaaatccaaacaatttagttgaaactggaacactacccattcttcgccttgctcacttttttttactaaatgaaagtgatgatgatgatcgaatacgtggtttaaccaaagagcagattgacaatctttccaccaggcactatgagcataacagtattgatagtgaactaggtaaaatctgtagtgtttgtattagtgactatgtaactggaaacaagctcaggcaattaccttgcatgcatgaatttcacattcattgtattgaccgatggctctcagagaattgcacttgtccgatctgtcggcagcctgttttagggtctaacatagcaaacaatgggtaaggtgatgggatctactcaaatactgttttttagtagaactgaatgttcaagcattgttttgctgagttatttgtgattagctaaccaggatgaaaaataacagattatatatagtttgaactatttttcgtgtgcttttttaaacttgttaaaaagaaatttatataaaatttaaaatacaaatgttaaattatccagaaatacagaatagttaatattgctagaaccaaataacctctaaaatgtttttattttggtaattttgtcatgctaagcacttttgtatctgcacaattcagtaggttaagaatcaatcttctttttcttaatagtacagcagactttagcttcaagtttcataggcttagtacttatatctagacatttgtgtctaaataagcttttcattaactttttattttaaggacagtatcttttcatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaaagtagagataatttactgaagcgtctctgacaatctaacttattagacagcaagcaatatataatactgaaaaagtattcagaaatggaaaatttacatcatataggttatttaacttgtgttcagcctttttgtaacttttttgaaagtgcaaacaattctttggattattaaataaggtatacagtatgcatggtttctcaaatttagttttaaaatctaaaagtctataaagaatcagatgcataggcaatatgttaagttcacttggaggctaaaaatctccagtgaaaacaaaacgaaaacctttaagagaatgtagagtttatataaacacaaagtatgcattgaagatctgtttctaccaataaacattaaaacaaagactgtaaaaaaaaaaaaaaa

SEQ ID NO: 157 - DNA, 3419 bp, Homo sapiens
gggaaagaaaccagtagcgggacggagggcgggggtggcaagaaagtcaaggtttagaagtaagccggagacgcctaaccctggtaacatccgaatgggaacgggataggaaggaaggcctttgagagaggaggcgtaaacccaggaacagtgacagtgtaggacgaaaggcctaagtttgttgcggaagatgggcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggagaaataacatcagaagaactgcaacagcggttagatggcgtcaaggaacaactagcatctcagcctgacttgagagatggaacgaattacagagactcagaagtccctagagaaagttcacatgaagattctcttctagaatggttgaacacctttcggcgcacaggaaatgcaactcgaagtggacaaaatgggaaccaaacttggagagctgtgagtcgaacaaacccgaacaatggagagtttcggtttagtttggaaatccacgtaaatcatgaaaatagaggatttgaaattcatggagaagattatacagacattccactttcagatagtaacagagatcatactgcaaataggcaacaaaggtcaactagtcctgtggctaggcgaacaagaagccaaacctcagtgaatttcaatggtagtagttccaacattccaaggactaggcttgcttcaagggggcaaaatccagctgaaggatctttctcaacattgggaaggttaagaaatggaattgggggagcagctggcattcctcgagctaacgcttcacgcactaatttcagtagtcacacaaaccaatcaggtggtagtgaactcaggcaaagggaggggcaacggtttggagcagcacatgtttgggaaaatggggctagaagtaatgttacagtgaggaatacaaaccaaagattagagccaataagattacgatctacttccaatagtcgaagccgttcaccaattcagagacagagtggcactgtttatcataattcccaaagggaaagtagaccagtacagcaaaccactagaagatctgttaggaggagaggtagaactcgagtctttttagagcaagatagagaacgagaacgcagaggtactgcatataccccattctctaattcaaggcttgtgtcaagaataacagtagaagaaggagaagaatccagcagatcctcaactgctgtacgacgacatccaacaatcacactggaccttcaagtgagaaggatccgtcctggagaaaatagagatcgggatagtattgcaaatagaactcgatccagagtagggctagcagaaaatacagtcactattgaaagcaatagtgggggctttcgccgaaccatttctcgtttagagcggtcaggtattcgaacctatgttagtaccataacagttcctcttcgtaggatttctgagaatgagcttgttgagccatcatcagtggctcttcggtcaattttaaggcagatcatgactgggtttggagaactgagttctctaatggaggccgattctgagtcagaacttcaaagaaatggccagcatttaccagacatgcactcagaactgagtaacttaggtacagataacaacaggagccagcacagggaaggttcctctcaagacaggcaggcccaaggagacagcactgaaatgcatggtgaaaacgagaccacccagcctcatactcgaaacagtgacagtaggggtggcaggcagttgcgaaatccaaacaatttagttgaaactggaacactacccattcttcgccttgctcacttttttttactaaatgaaagtgatgatgatgatcgaatacgtggtttaaccaaagagcagattgacaatctttccaccaggcactatgagcataacagtattgatagtgaactaggtaaaatctgtagtgtttgtattagtgactatgtaactggaaacaagctcaggcaattaccttgcatgcatgaatttcacattcattgtattgaccgatggctctcagagaattgcacttgtccgatctgtcggcagcctgttttagggtctaacatagcaaacaatgggtaaggtgatgggatctactcaaatactgttttttagtagaactgaatgttcaagcattgttttgctgagttatttgtgattagctaaccaggatgaaaaataacagattatatatagtttgaactatttttcgtgtgcttttttaaacttgttaaaaagaaatttatataaaatttaaaatacaaatgttaaattatccagaaatacagaatagttaatattgctagaaccaaataacctctaaaatgtttttattttggtaattttgtcatgctaagcacttttgtatctgcacaattcagtaggttaagaatcaatcttctttttcttaatagtacagcagactttagcttcaagtttcataggcttagtacttatatctagacatttgtgtctaaataagcttttcattaactttttattttaaggacagtatcttttcatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaaagtagagataatttactgaagcgtctctgacaatctaacttattagacagcaagcaatatataatactgaaaaagtattcagaaatggaaaatttacatcatataggttatttaacttgtgttcagcctttttgtaacttttttgaaagtgcaaacaattctttggattattaaataaggtatacagtatgcatggtttctcaaatttagttttaaaatctaaaagtctataaagaatcagatgcataggcaatatgttaagttcacttggaggctaaaaatctccagtgaaaacaaaacgaaaacctttaagagaatgtagagtttatataaacacaaagtatgcattgaagatctgtttctaccaataaacattaaaacaaagactgtaaaaaaaaaaaaaaa

SEQ ID NO: 158 - DNA, 1227 bp, Homo sapiens
gcaagagggcggaacgcgggacgccaggcaccctagctcccgacggacgcagttttcagttgcacgggcgagctccgggccggctgcggagcgactccccgccgccaagtgggcggcgtggctgtcgggaaagaagggctggggcctgccgttcttcctcccgagtatcccctccagctggacgaccccacgctgcagcacgggcttccggcttctctcctcagtggccaattcgagggcacagcgggctccggaggcgcggcggcaagcctatcccgcctcccaaccacagcctccagcacccgagagaacggccgcccacagcacacgttctccggacaggagggcgaaggcccaagacctggagagatgggcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggagaaataacatcagaagaactgcaacagcggttagatggcgtcaaggaacaactagcatctcagcctgacttgagagatggaacgaattacagagactcagaagtccctagagaaagttcacatgaagattctcttctagaatggttgaacacctttcggcgcacaggaaatgcaactcgaagtggacaaaatgggaaccaaacttggagagctgctttgccagatacaagctgaagtgctaccagaaaaccagttgttaagtctatctggaaaaatagactgtgaagcacctcatcttcatttcaatagcttcgctggaacctggagcctaaggggtaaaatgtattatctttctcttcacaaacagttttttttcttttatggaacatagaatatgacaacatttgttttgtcaactgattacattttaaaacattgtacttgttcatattgtacttggctttgaaataccctgaagcatctatggaattgtaatttattgtaatgcaataagcatttatgtaattaaaaaaaagcattcttaaatatgaaaaaaaaaaaa

SEQ ID NO: 159 - DNA, 2381 bp, Homo sapiens
cgggggctggcggctgcggctcggcggagagtgcggcatgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaaaaaaaaaaaaaaaaaaaaaaaa

SEQ ID NO: 160 - DNA, 2282 bp, Homo sapiens
cgggggctggcggctgcggctcggcggagagtgcggcatgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaagatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaaaaaaaaaaaaaaaaaaaaaaaa

SEQ ID NO: 161 - DNA, 2172 bp, Homo sapiens
gggcagtggctcgtgggagccaagatggcggcggcggcggcagcgacagcagcagcagcagccagtattcgggaaaggcagacagtggctttgaagcgtatgttgaatttcaatgtgcctcatattaaaaacagcacaggagaaccagtatggaaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaataaaatttcaacattgttaaaaaaaaaaaaaaaa

SEQ ID NO: 162 - DNA, 2101 bp, Homo sapiens
gggcagtggctcgtgggagccaagatggcggcggcggcggcagcgacagcagcagcagcagccagtattcgggaaaggcagacaggtactcatttatgacagatttggccaagatataatctctcctctgctatctgtgaaggagctaagagacatgggaatcactctgcatctgcttttacactctgatcgagatcctattccagatgttcctgcagtatactttgtaatgccaactgaagaaaatattgacagaatgtgccaggatcttcgaaatcaactatatgaatcatattatttaaattttatttctgctatttcaagaagtaaactggaagatattgcaaatgcagcgttagcagctagtgcagtaacacaagtagccaaggtttttgaccaatatctcaattttattactttggaagatgatatgtttgtattatgtaatcaaaataaggagcttgtttcatatcgtgccattaacaggccagatatcacagacacggaaatggaaactgttatggacactatagttgacagcctcttctgcttttttgttactctgggtgctgttcctataatcagatgttcaagaggaacagcagcagaaatggtagcagtgaaactagacaagaaacttcgagaaaatctaagagatgcaagaaacagtctttttacaggtgatacacttggagctggccaattcagcttccagaggcccttattagtccttgttgacagaaacatagatttggcaactcctttacatcatacttggacatatcaagcattggtgcacgatgtactggatttccatttaaacagggttaatttggaagaatcttcaggagtggaaaactctccagctggtgctagaccaaagagaaaaaacaagaagtcttatgatttaactccggttgataaattttggcaaaaacataaaggaagtccattcccagaagttgcagaatcagttcagcaagaactagaatcttacagagcacaggaagatgaggtcaaacgacttaaaagcattatgggactagaaggggaagatgaaggagccataagtatgctttctgacaataccgctaagctaacatcagctgttagttctttgccagaactccttgagaaaaaaagacttattgatctccatacaaatgttgccactgctgttttagaacatataaaggcaagaaaattggatgtatattttgaatatgaagaaaaaataatgagcaaaactactctggataaatctcttctagatataatatcagaccctgatgcaggaactccagaagataaaatgaggttgtttcttatctattatataagcacacagcaagcaccttctgaggctgatttggagcaatataaaaaagctttaactgatgcaggatgcaaccttaatcctttacaatatatcaaacagtggaaggcttttaccaagatggcctcagctccggccagctatggcagcactaccactaaaccaatgggtcttttatcacgagtcatgaatacaggatcacagtttgtgatggaaggagtgaagaacctggttttgaaacagcaaaatctacctgttactcgtattttggacaatcttatggagatgaagtcaaaccccgaaactgatgactatagatattttgatcccaaaatgctgcggggcaatgacagctcagttcccagaaataaaaatccattccaagaggccattgtttttgtggtgggaggaggcaactacattgaatatcagaatcttgttgactacataaaggggaaacaaggcaaacacattttatatggctgcagtgagctttttaatgctacacagttcataaaacagttgtcacaacttggacaaaagtaacacagaagaaccttactatgataatctacttggaatgtggataaatgtaaaaagaagaaaagttagaagagcaatatgtttccttctctgtaacagtgtcctaacagtgaaaatcagagttatttgttaatttttaaggaaattatatacttaatatgtattgattaaaagaaacatttcagaaataaaatttcaacattgttaaaaaaaaaaaaaaaa

SEQ ID NO: 163 - DNA, 1587 bp, Homo sapiens
cgcgtagccagtgaaggttggggagcaagcttatgcgggaaagagggagggggactccaggaaaagccgttgagaggaccatcacaacctgagcagcacaggttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtgagtgaattagatgtatcctttttcaatactgttttccacagtacttggcaaatgcactctggtccttatcaggaaccaattgatgaacttcccaaaatatgctcagccctggagccccagcagacttgcttttctccagacagttcatcattcaaaggagctgcctccaccacccccatctactgaatagccaggggagggcaccaatgaacagcacagtatgggagacacaccaactactcttcaaatcagtgcgtacctgctctacgcgtgaaggtacagaaaacctccacggccttttcagtatttggtgcctttaaagaggcctaaggacttagtttatttgggctagactggaatgcagcagtactgccttcaggcctggacagccaggggctcctcgggccctgtgctctagaaggcccattctatgtctgcttcgccagcaccctttccccatcatggggcagatgcccaccagccctcactatctactgcttgaccatcctctgacttcctgggcccctagaatttataaggtccctagatatcccagaacctgccaccatggcctctgcaagcctctcctccaccttcaccccaagactaggggcaggaatgataagaaggctgggtggtagctgggatgtcccacctacgtgcctggggagagaagcaagagcaggctggagtctctactttgtattcttgtgaggcacaaatataggctagaatccaggccccacaaatataggctagaatccggaatgttttcttgatttaaagacatctttagaccgggcacagtggctcacgccagtaatcccagcactttggagggctgaagcaggaggattgcttgaggccgggagtttgagaccagcctgggcaacatggggagacccagtctctacaaaaaaatttaaaaagccaggcattggtggtgtgtgcctatagtcccaactactagggaggctgaggtgggaggatcacttgagcctgggggactgaggctgcagtgagccatgattgtgctactgcactccaatctggcaacagagcgagaccttgtctttaaaaataaaaataaaaacatctttacaacaaaaaaaaaaaaaaaa

SEQ ID NO: 164 - DNA, 2051 bp, Homo sapiens
tggggtgtcgctccgggctggtggcggggccactgccccgcttgggggaagccgagcgatggtttgtgggcgccagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcagtgaatcttgcacttgcactagcagcgaacgattcgtccaaggccattggtttgctagatgtggatgtgtatggaccttcagttccaaagatgatgaatctgaaaggaaatccggaattatcacagagcaacctaatgaggcctctcttgaattatggtattgcttgtatgtctatgggctttctggttgaagaaagtgaaccagtagtttggagaggccttatggtaatgtcggccattgagaaattgttgaggcaggtagattggggtcaactggactacttagttgtagacatgccaccaggaactggagatgtgcagttatcagtctcacagaatattcctataacaggtgctgtgattgtctccacgccccaggacatcgcattgatggatgcacacaagggtgctgagatgtttcgcagagtccacgtgcccgtccttggccttgtccaaaacatgagtgttttccagtgtccaaaatgtaaacacaaaactcatatttttggtgctgatggtgcaaggaaactagcacagacccttggtcttgaagttctaggagacattcccttacaccttaatataagggaagcttcagatacaggccagccaattgtgttttcacagcctgaaagtgatgaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcatgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacataatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatacgcctgtaatcccagctactcgggaggctgaggcaggagaatcatttcaacccgggaggctgaggttgcagtgagtggagattgtaccactgcactccagcctggtcaatggagtgcgactccatctc

SEQ ID NO: 165 - DNA, 4992 bp, Homo sapiens
ccgcggtgagccgcgaggaagagaggcgagcgagagtggaggaggaggcggcggctgcgggacggtccccaggaatgtcgctgccccccccccccctgccgttgaggaggagacggaggagaccgacgttgttagggaagatgatccctatgatctgccgctgtttctgcacagaaatgagggaaatacaaagaaccaaatacagttctaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggcttagaacaagactttgaacagaagcaaatgcctgaagggaagctcaacgtagatggatttttattatgcattgatgtaagtcaaggatgcaataggaagtttgatgatcaacttaaatttgtgaataacctttttgtccagttatcaaaatcaaaaaaacctgtaataatagcagcaactaaatgtgatgaatgcgtgggtcattatcttagagaagttcaggcatttgcttcaaataaaaagaaccttcttgtagtggaaacactcagcgcaataaaagtcaacattgaaacatgttttactgcactggtacaaatgttggataaaactcgtagcaagcctaaaattattccctatttggatgcttataaaacacagagacaacttgttgtcacagcaacagataagtttgaaaaacttgtgcagactgtgagagattatcatgcaacttggaaaactgttagtaataaattaaaaaatcatcctgattatgaagaatacatcaacttagagggaacaagaaaggccagaaatacattctcaaaacatatagaacaacttaaacaggaacatataagaaaaaggagagaagagtatataaatactttaccaagagcttttaacactcttttgccaaatctagaagagattgaacatttgaattggtcagaagctttgaagttaatggaaaagagagcagatttccagttatgttttgtggtgctagaaaaaactccttgggatgaaactgaccatatagacaaaattaatgataggcggattccatttgacctcctgagcactttagaagctgaaaaagtctatcagaaccatgtacagcatctgatatccgagaagaggagggtggaaatgaaggaaaaattcaaaaagactttggaaaaaattcaattcatttcaccagggcagccatgggaggaagttatgtgctttgttatggaggatgaagcctacaaatatatcactgaggctgatagcaaagaggtatatggtaggcatcagcgagaaatagttgaaaaagccaaagaagagtttcaagaaatgctttttgagcattctgaacttttttatgatttagatcttaatgcaacacctagttcagataaaatgagtgaaattcatacagttctgagtgaagaacctagatataaagctttacagaaacttgcacctgatagggaatcccttctacttaagcatataggatttgtttatcatcccactaaagaaacatgtcttagtggccaaaattgtacagacattaaagtggagcagttacttgctagtagtcttttacagttggatcatggccgcttaagattatatcacgatagtaccaatatagataaagttaacctttttattttagggaaggatggccttgcccaagaactagcaaatgagataaggacacaatccactgatgatgagtatgccttagatggaaaaatttatgaacttgatcttcggccggttgatgccaaatcgccttactttttgagtcagttatggactgccgcctttaaaccacatgggtgcttctgtgtatttaattccattgagtcattgagttttattggggaatttattgggaaaataagaactgaagcttctcagatcagaaaagataaatacatggctaatcttccatttacattaattctggctaatcagagagattccattagtaagaatctaccaattctcaggcaccaagggcagcagttggcaaacaagttgcaatgtccttttgtagatgtacctgctggtacatatcctcgtaaatttaatgaaacccaaataaagcaagctctcagaggagtattggaatcagttaaacacaatttggatgtggtgagcccaattcctgccaataaggacttatcagaagctgacttgagaattgtcatgtgcgccatgtgtggagatccatttagtgtggatcttattctttcacccttccttgattctcattcttgcagtgctgctcaagctggacagaataattccctaatgcttgataaaatcattggtgaaaaaaggaggcgaatacagatcacaatattatcataccactcttcaattggagtaagaaaagatgaactagttcatgggtatatattagtttactctgcaaaacggaaagcttcgatgggaatgcttcgagcatttctatcagaagttcaagacaccattcctgtacagctggtggcagttactgacagccaagcagatttttttgaaaatgaggctatcaaagagttaatgactgaaggagaacacattgcaactgagatcactgctaaatttacagcactgtattctttatctcagtatcatcggcaaactgaggtctttactctgttttttagtgatgttctagagaaaaaaaatatgatagaaaattcttatttgtctgataatacaagggaatcaacccatcaaagtgaagatgtttttctaccatctcccagagactgttttccctataataactaccctgattcagatgatgacacagaagcaccacctccttatagtccaattggggatgatgtacagttgcttccaacacctagtgaccgttccagatatagattagatttggaaggaaatgagtatcctattcatagtaccccaaactgtcatgaccatgaacgcaaccataaagtgcctccacctattaaacctaaaccagttgtacctaagacaaatgtgaaagcgctcgttccaaaccttttaagggcaattgaagctggtattggtaaaaatccaagaaagcagacttcccgggtgcctttcggtcctgaagatatggatccttcagataactatgcggaacccattgatacaattttcaaacagaagggctattctgatgagatttatgttgtcccagatgatagtcaaaatcgtattaaaattcgaaactcatttgtaaataacacccaaggagatgaagaaaatgggttttctgatagacctcaaaaagtcatggggaacggaggccttcaaaatacaaatataaatctaaaaccttgtttagtaaagccaagtcatactatagaagaacacattcagatgccagtgatgatgaggctttcaccacttctaaaaccaaaaagaaaaggaagacatcgtggaagtgaagaagatccacttctttctcctgttgaaacttggaaaggtggtattgataatcctgcaatcacttctgaccaggagttagatgataagaagatgaagaagaaaacccacaaagtgaaagaagataaaaaaaagaaaactaagaacttcaatccaccaacacgtagaaattgggaaagtaattactttgggatgcccctccaggatctggttacagctgagaagcccataccactatttgttgagaaatgtgtggaatttattgaagatacagggttatgtaccgagagactctaccgtgtcagcgggaataaaactgaccaagaaaatattcaaaagcagtttgttcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaacataaaatcaacctaatgacagcagacaacttatccatctgttttggccaacccttgatgagacctgatttgaaatcgatggagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttcagggttcagtagtatacttcatgtttcatacagataattcacattcaaaattacattttctctttgaactagatggtattccttattcacttacattacaaatctaagaccatgtgataagcatgact

SEQ ID NO: 166 - DNA, 3428 bp, Homo sapiens
ccacgcgtccgacgccccccacccgggaggggggagagaggcaaaaagtaagagaggaaaaaaaatagcaggaagatggcgcccaccaagcccagctttcagcaggatccttccaggcgagaacgtttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaaggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggagtcaaccagccccagtctgctaaccactgacaacactcttgagcgttcctttttcatccgaatgaaatctactctgaccaaacgcggtgtgcacatcaaatcatcaggatataaggtgattcacataacaggccggctacgcctgagagtgtcgctgtcccacgggaggaccgtccccagccaaatcatgggtctcgtggttgttgcgcatgccttgcctccccctacgatcaatgaagtcagaattgactgccatatgttcgtcactcgagtaaatatggacctcaatatcatttactgtgaaaataggattagtgattatatggatctgacccctgtagatatcgtagggaagagatgctaccacttcatccatgctgaagacgtggagggcatcaggcacagtcacttggacttgctgaataagggtcagtgtgtgacaaagtactatcgctggatgcagaagaacggaggatatatttggatacagtccagtgccaccatagctattaatgccaagaatgcaaatgaaaagaatatcatctgggtgaattaccttcttagcaatcctgagtacaaggacacacccatggacatcgcacagctcccccatctgccggagaaaacttccgaatcctcggagacatccgactctgagtcagactctaaagacacctcaggtattacagaggacaacgagaactccaagtccgacgagaaggggaaccagtccgagaacagcgaagacccggagcccgaccggaagaagtcgggcaacgcgtgtgacaacgacatgaactgcaacgacgacggccacagctccagtaacccggacagccgcgacagcgacgacagcttcgagcactcggactttgagaaccccaaggcgggcgaggacggcttcggtgctctgggcgcgatgcagatcaaggtggagcgctacgtggagagcgagtcggacctgcggctgcagaactgcgagtcactcacgtccgacagcgccaaggactcggacagcgcaggcgaggcgggcgcgcaggcctccagcaagcaccagaagcgcaagaaaaggcggaaacggcaaaagggcggcagcgccagccgccggcgcctgtccagcgcgtcgagcccaggcggcctggacgcgggcctggtggagcccccgcggctgctgtcctcccccaacagtgcctcggtgctcaagatcaagacggagatctcagaacccatcaatttcgacaatgacagcagcatctggaactacccgcccaaccgggagatctccaggaacgagtccccctacagcatgaccaagccccccagctctgagcacttcccgtccccgcagggcggcggcggtgggggtggcggtggcggggggctgcacgtggccattcccgactcggtcctcaccccgcccggcgccgacggcgcggccgcccgcaagactcagttcggcgcctcggccaccgcggccctggcccccgtcgcctccgacccgctgtcacccccgctctcggcgtccccgcgggacaagcaccccgggaacggcggcgggggcgggggcgggggcggcggcgcggggggcggcggccccagcgcgtccaactccttgctgtacactggggacctggaggcgctgcagaggttgcaggcgggcaacgtcgtgctcccgctggtgcacagggtgaccgggaccctggccgccaccagcacggccgcgcagagggtctacaccacgggcaccatccgctacgcgcccgccgaggtgaccctggccatgcagagcaacctgctgcccaacgcgcacgctgttaacttcgtggacgttaacagccccggctttggcctcgaccccaagacgcccatggagatgctctaccaccacgtgcaccggctcaacatgtcaggaccgttcggcggcgcagtgagcgcagctagcctgacgcagatgcccgccggcaacgtgttcaccacggccgagggactcttctccacgctgcccttccccgtctacagcaacggcatccacgcggcacagactctggagcgcaaggaggactgaggcgccgcccgtcctgggcccggccaggccccgcttggaggaggcatcgtcggcattttcgtttagacctttaattctagcactttgaattcgagcaggtcagcgtcttctctcgccacgacggtccccattccaccccctctttctttcacctgacttattctttcgtgtaaagatatgtttattttttgccttcagagggtcagacgaccagttgcctgccgttttgtcttcttctaaggtgtgtgttgggttgttttgctttcctttgcatctttattaagatgtctttcatgtgtatatgcctctgccatagaatactcagtcttgtggtcaagagagttctcaagtgacaaccattggggtttcttcataaagatcttgatatgatcaagatggaaagagacaagcataaacaatgtgccctgtttgactaagtcaaatgaaatagggtggtttttgtttctgttcctaattcctttaaaaaatagggggaatagtattttagaattttatgcagaatttaattctctttttacggttaagattttaagattttcttacttgcacataaaaataatttgggttcttaaacttaatttctggcctgtgactagaatgtttaaaaaaaaaaaaaaccctcgtgc

SEQ ID NO: 167 - DNA, 2763 bp, Homo sapiens
atggcgcccaccaagcccagctttcagcaggatccttccaggcgagaacgtttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaagggatacaaatgtggaaatctgaactctgcatgagaaagacaccatgtgaagttataggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggagtcaaccagccccagtctgctaaccactgacaacactcttgagcgttcctttttcatccgaatgaaatctactctgaccaaacgcggtgtgcacatcaaatcatcaggatataaggtgattcacataacaggccggctacgcctgagagtgtcgctgtcccacgggaggaccgtccccagccaaatcatgggtctcgtggttgttgcgcatgccttgcctccccctacgatcaatgaagtcagaattgactgccatatgttcgtcactcgagtaaatatggacctcaatatcatttactgtgaaaataggattagtgattatatggatctgacccctgtagatatcgtagggaagagatgctaccacttcatccatgctgaagacgtggagggcatcaggcacagtcacttggacttgctgaataagggtcagtgtgtgacaaagtactatcgctggatgcagaagaacggaggatatatttggatacagtccagtgccaccatagctattaatgccaagaatgcaaatgaaaagaatatcatctgggtgaattaccttcttagcaatcctgagtacaaggacacacccatggacatcgcacagctcccccatctgccggagaaaacttccgaatcctcggagacatccgactctgagtcagactctaaagacacctcaggtattacagaggacaacgagaactccaagtccgacgagaaggggaaccagtccgagaacagcgaagacccggagcccgaccggaagaagtcgggcaacgcgtgtgacaacgacatgaactgcaacgacgacggccacagctccagtaacccggacagccgcgacagcgacgacagcttcgagcactcggactttgagaaccccaaggcgggcgaggacggcttcggtgctctgggcgcgatgcagatcaaggtggagcgctacgtggagagcgagtcggacctgcggctgcagaactgcgagtcactcacgtccgacagcgccaaggactcggacagcgcaggcgaggcgggcgcgcaggcctccagcaagcaccagaagcgcaagaaaaggcggaaacggcaaaagggcggcagcgccagccgccggcgcctgtccagcgcgtcgagcccaggcggcctggacgcgggcctggtggagcccccgcggctgctgtcctcccccaacagtgcctcggtgctcaagatcaagacggagatctcagaacccatcaatttcgacaatgacagcagcatctggaactacccgcccaaccgggagatctccaggaacgagtccccctacagcatgaccaagccccccagctctgagcacttcccgtccccgcagggcggcggcggtgggggtggcggtggcggggggctgcacgtggccattcccgactcggtcctcaccccgcccggcgccgacggcgcggccgcccgcaagactcagttcggcgcctcggccaccgcggccctggcccccgtcgcctccgacccgctgtcacccccgctctcggcgtccccgcgggacaagcaccccgggaacggcggcgggggcgggggcgggggcggcggcgcggggggcggcggccccagcgcgtccaactccttgctgtacactggggacctggaggcgctgcagaggttgcaggcgggcaacgtcgtgctcccgctggtgcacagggtgaccgggaccctggccgccaccagcacggccgcgcagagggtctacaccacgggcaccatccgctacgcgcccgccgaggtgaccctggccatgcagagcaacctgctgcccaacgcgcacgctgttaacttcgtggacgttaacagccccggctttggcctcgaccccaagacgcccatggagatgctctaccaccacgtgcaccggctcaacatgtcaggaccgttcggcggcgcagtgagcgcagctagcctgacgcagatgcccgccggcaacgtgttcaccacggccgagggactcttctccacgctgcccttccccgtctacagcaacggcatccacgcggcacagactctggagcgcaaggaggactga

SEQ ID NO: 168 - DNA, 1340 bp, Homo sapiens
ggcacaagggggcgctttagggactggacttgcagtgtaaacagagacgctgcaaattgcttgtggacggtgtaggccgctgcaggccaccatgaaccggcttccggatgactacgacccctacgcggttgaagagcctagcgacgaggagccggctttgagcagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagtacaggtgaccaagaaaaaaaagaagaaacaacacaagattccaacaaatgacgaattactgtatgatcctgaaaaagataacagagatcaggcctgggttgatgcacagagaaggggttaccatggtttgggaccacagagatcacgtcaacaacagcctgttccaaatagtgatgctggtcttgaattgtcctgcctgcatgaccacactcttgccttgattgccaaaggcatgaatcatacaaaaactcaatatagagcaatgtttgtaatgaattgttctattaacaaagaggaggttctaagatataaagcctcagagaacaaggaagaaaaggcgggtccataagaagatgaggtctaaccgggaagatgctgccgagaaggcagagacagatgtggaagaaatctatcacccagtcatgtgcactgaatgttccactgaagtggcagtctacgacaaggatgaagtctttcattttttcaatgttttagcaagccattcctaaacagcccaactggcatttaattacccaatactgtatataaggcaaatatggacagttactttcctcttgcctgttcatatccttcagtgacattgaggaagcagtgtttctctttttaaaggagaatagttgtcaaccttcattcatctcttacatctctcaccctctccttttttttttctttgattttcccccttattgatgggactgatattcattctgtttttgatgaacatttggaaactgtcgggctttttattaaagctctgtagaattaaaatgttctggaattataagcaatctttgtttctgagtgttatttttattttggatatagctttgatgtaattaaactggaaactctttcctgaattgtctgtaaaaaaa

SEQ ID NO: 169 - DNA, 3041 bp, Homo sapiens
tgggtgttctccgcggcgccgagtcccgggagcgcggtgggggcagcgggcgcggggcgggcgcggggaccgcgccagcctgtcactaatgtctccctttgtgtctcccccatctcatccttttccccggcgcgccgtgcccgccgaccccacaggaaggcctggacgacggcccggacttcctctcagaagaggaccgcggacttaaagcaataaatgtagatcttcaaagtgatgctgctctgcaggtggacatttctgatgctcttagtgagcgggataaagtaaaattcactgttcacacaaagagttcattgccaaattttaaacaaaacgagttttcagttgttcggcaacatgaggaatttatctggcttcatgattcctttgttgaaaatgaagactatgcaggttatatcattccaccagcaccaccaagacctgattttgatgcttcaagggaaaaactacagaagcttggtgaaggagaagggtcaatgacgaaggaagaattcacaaagatgaaacaggaactggaagctgaatatttggcaatattcaagaagacagttgcgatgcatgaagtgttcctgtgtcgtgtggcagcacatcctattttgagaagagatttaaatttccatgtcttcttggaatataatcaagatgtgagtgtgcgaggaaaaaataaaaaagagaaacttgaagacttctttaaaaacatggttaaatcagcagatggagtaatcgtttcaggagtaaaggatgtagatgatttctttgagcacgaacgaacatttcttttggagtatcataaccgagttaaggatgcatctgctaaatctgatagaatgacaagatcccacaaaagtgctgcagatgattacaatagaattggttcttcattatatgctttaggaactcaggattctacagatatatgcaagttttttctcaaagtttcagaactgttcgataaaacaagaaaaatagaagcacgagtgtctgctgatgaagacctcaaactttctgatcttttaaaatattacttaagagaatctcaagctgctaaggatctcctgtatcgaaggtctaggtcactagtggattatgaaaatgctaataaagcactggataaagcaagagcaaaaaataaagatgttctacaggccgaaacttcccaacaattatgttgtcagaaatttgaaaaaatatctgagtctgcaaaacaagaacttatagattttaagacaagaagagttgctgcattcagaaaaaatttagtggaactggcagagttagaactgaagcatgcaaagggtaatctacagttgctgcagaactgcctggcagtgttaaatggagacacataagccacactccgccttcctgttaaaaagggctgccttccttcaaattttatttttgttttcttaatgatgttaagcatttatgctcactggaaacaaacaaaaagcagctgaaaaagtgcatcaactcctctttttctgagaaacatggagcagcgcacgcccaggcgatgccagtctgtgtgccgtgatgccgcactgtgttccccatgacagtggtccatcatcgtgcactcgtcatactcagaagtccaaagttcattcttctttaaagtagcctctataactctgtttattttataaatagtattccttatggctgccactcttatttacctttaaataatttctgaaatttaaccttttcagaatgcattgttgaaacaagataaagattgccttttttgaattttttaaattttgtttttaaaagcatataccaccttagttcattcatgtatcctggtaaagcatcttaatcagacttatttttaattactgaatatttcttagacgttttgggacagattttatgtaatctttataagtatgatttctgaagaaaagcaaatgcattagtatgtttgccttaaacttgtagactaaaccaagtattgtaaaataaacagcgataacagtgatagtttttaactctatggtcattgtatcactctggaaaatgtggagtagctgtaataaatctactcctgtattatgctttacagtgcaggtcttagtttttcttttttctcatttcttttgaaatggcatctcgaacaaagtccaccaatccctttacaaaagaatgaactgctcctctgtgtgtacttcatagaaggtggaatcggacagaggcaggttagtgacagttattcctgaaatacaggagcagagtacagtctgttgtggtttcccggattccgcgcctagctcagccaattaagcatgagacataggccattgagccacttagtagttatgcgagtggatagattggtatgtagagggaaagaggtctgctgtaaagaacaacacttgtttgtctgtggggaaagaaaagcagaatacttgagatgaaagttggcatacaaataggatactatcgccagtagttatattacaaacattatcggcctttctagtgtgaatgaacattagacacattattgtcattcctagtttaaagttaaggttgcgtggttggatttttccactatctttttagtttgtttacattttcctgaaccctcctgagcgcccgttcttggtctaatccccagtcgtgatgattccacacttcctcagccgcatgttgtcttgcctcattcatgagctggtcagcgtttcgtctctttaactgacatgttccccagtgctgtttgaactgttgagtttccgttgctggctgagtgcgttttgtccttcacgtaaccttcgctggtaaaaataagcccatgtgatgtccaccagtggatgaatgctggaccgagagccctagcttctggatccaggtctaggcccttcatctgctgctctgtggcccagggcaggtttgcttgacctctgcctcagttctcgactctaaaggacatactgacctacctcacaggggtgttgtgaggattaataaatgttggtactctgctttggaaaaaaaaaaaaaaaaaaaaaaaa

SEQ ID NO: 170 - DNA, 2917 bp, Homo sapiens
cacgcgtccgcgcctcggagcagccatgatggaaggcctggacgacggcccggacttcctctcagaagaggaccgcggacttaaagcaataaatgtagatcttcaaagtgatgctgctctgcaggtggacatttctgatgctcttagtgagcgggataaagtaaaattcactgttcacacaaagagttcattgccaaattttaaacaaaacgagttttcagttgttcggcaacatgaggaatttatctggcttcatgattcctttgttgaaaatgaagactatgcaggttatatcattccaccagcaccaccaagacctgattttgatgcttcaagggaaaaactacagaagcttggtgaaggagaagggtcaatgacgaaggaagaattcacaaagatgaaacaggaactggaagctgaatatttggcaatattcaagaagacagttgcgatgcatgaagtgttcctgtgtcgtgtggcagcacatcctattttgagaagagatttaaatttccatgtcttcttggaatataatcaagatgtgagtgtgcgaggaaaaaataaaaaagagaaacttgaagacttctttaaaaacatggttaaatcagcagatggagtaatcgtttcaggagtaaaggatgtagatgatttctttgagcacgaacgaacatttcttttggagtatcataaccgagttaaggatgcatctgctaaatctgatagaatgacaagatcccacaaaagtgctgcagatgattacaatagaattggttcttcattatatgctttaggaactcaggattctacagatatatgcaagttttttctcaaagtttcagaactgttcgataaaacaagaaaaatagaagcacgagtgtctgctgatgaagacctcaaactttctgatcttttaaaatattacttaagagaatctcaagctgctaaggatctcctgtatcgaaggtctaggtcactagtggattatgaaaatgctaataaagcactggataaagcaagagcaaaaaataaagatgttctacaggccgaaacttcccaacaattatgttgtcagaaatttgaaaaaatatctgagtctgcaaaacaagaacttatagattttaagacaagaagagttgctgcattcagaaaaaatttagtggaactggcagagttagaactgaagcatgcaaagggtaatctacagttgctgcagaactgcctggcagtgttaaatggagacacataagccacactccgccttcctgttaaaaagggctgccttccttcaaattttatttttgttttcttaatgatgttaagcatttatgctcactggaaacaaacaaaaagcagctgaaaaagtgcatcaactcctctttttctgagaaacatggagcagcgcacgcccaggcgatgccagtctgtgtgccgtgatgccgcactgtgttccccatgacagtggtccatcatcgtgcactcgtcatactcagaagtccaaagttcattcttctttaaagtagcctctataactctgtttattttataaatagtattccttatggctgccactcttatttacctttaaataatttctgaaatttaaccttttcagaatgcattgttgaaacaagataaagattgccttttttgaattttttaaattttgtttttaaaagcatataccaccttagttcattcatgtatcctggtaaagcatcttaatcagacttatttttaattactgaatatttcttagacgttttgggacagattttatgtaatctttataagtatgatttctgaagaaaagcaaatgcattagtatgtttgccttaaacttgtagactaaaccaagtattgtaaaataaacagcgataacagtgatagtttttaactctatggtcattgtatcactctggaaaatgtggagtagctgtaataaatctactcctgtattatgctttacagtgcaggtcttagtttttcttttttctcatttcttttgaaatggcatctcgaacaaagtccaccaatccctttacaaaagaatgaactgctcctctgtgtgtacttcatagaaggtggaatcggacagaggcaggttagtgacagttattcctgaaatacaggagcagagtacagtctgttgtggtttcccggattccgcgcctagctcagccaattaagcatgagacataggccattgagccacttagtagttatgcgagtggatagattggtatgtagagggaaagaggtctgctgtaaagaacaacacttgtttgtctgtggggaaagaaaagcagaatacttgagatgaaagttggcatacaaataggatactatcgccagtagttatattacaaacattatcggcctttctagtgtgaatgaacattagacacattattgtcattcctagtttaaagttaaggttgcgtggttggatttttccactatctttttagtttgtttacattttcctgaaccctcctgagcgcccgttcttggtctaatccccagtcgtgatgattccacacttcctcagccgcatgttgtcttgcctcattcatgagctggtcagcgtttcgtctctttaactgacatgttccccagtgctgtttgaactgttgagtttccgttgctggctgagtgcgttttgtccttcacgtaaccttcgctggtaaaaataagcccatgtgatgtccaccagtggatgaatgctggaccgagagccctagcttctggatccaggtctaggcccttcatctgctgctctgtggcccagggcaggtttgcttgacctctgcctcagttctcgactctaaaggacatactgacctacctcacaggggtgttgtgaggattaataaatgttggtactctgctttggaaaaaaaaaaaaaaaaaaaaaaaa

SEQ ID NO: 171 - DNA, 1999 bp, Homo sapiens
gagggaggggccgccggggaagaggaggaggaaggaaagaaagaaagcgagggagggaaagaggaggaaggaagatgcgagaaggcagaggaggagggagggagggaaggagcgcggagcccggcccggaagctaggtgagtgtggcatccgagctgagggacgcgagcctgagacgccgctgctgctccggctgagtatctagcttgtctccccgatgggattcccgtccaagctatctcgagcctgcagcgccacagtccccggccctcgcccaggttcactgcaaccgttcagaggtccccaggagctgctgctggcgagcccgctactgcagggacctatggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggcgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaatggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggt

SEQ ID NO: 172 - DNA, 1790 bp, Homo sapiens
gagggaggggccgccggggaagaggaggaggaaggaaagaaagaaagcgagggagggaaagaggaggaaggaagatgcgagaaggcagaggaggagggagggagggaaggagcgcggagcccggcccggaagctaggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggcgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaatggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggt

SEQ ID NO: 173 - DNA, 1779 bp, Homo sapiens
gaaggaagtggcgggggaaggagtgtggtggtggtttaaaaaataagggaagccgaggcgagagagacgcagacgcagaggtcgagcgcaggccgaaagctgttcaccgttttctcgactccggggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggcgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaatggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggt

SEQ ID NO: 174 - DNA, 1999 bp, Homo sapiens; identical to SEQ ID NO: 171

SEQ ID NO: 175 - DNA, 1790 bp, Homo sapiens; identical to SEQ ID NO: 172

SEQ ID NO: 176 - DNA, 1779 bp, Homo sapiens; identical to SEQ ID NO: 173

SEQ ID NO: 177 - DNA, 1353 bp, Homo sapiens
agttactgaacccttatcaagcagctgcctgggactcaatttgccccatccattggagattaaccgacatcatcgaggggggcagcctgcgcatcccgctccaggaactgcaccagatgatcctgactccgatcaaggcctacagctccccgagcaccacccccgaggctcgccgccgggagccccaggccccgcgtcagccctcactgatgggccccgagagccagagccccgactgcaaagatggggccgcagccactggcgccacggccaccccctcggccggggccagcggggggctccagccgcaccagctgagcagctgcgatggggagctggccgtcgcccccctgccagagggggacctccccgggcagttcacacgcgtcatggggaaagtgtgcacacagctcttggtctccagacctgatgaggaaaatataagttcctatttacagctcatagacaagtgtctaattcatgaggcatttacagagacacagaaaaaaagattgttgtcatggaaacagcaggtgcagaagctctttcggtctttccctcggaaaacccttctagacatatcaggatatcgacagcaaagaaatcgaggctttgggcaatccaactccctcccgacggctggctctgtgggcggtggcatgggcagacggaacccgcgccagtaccagatcccctctcggaacgtcccttccgcccgcctgggcctcttgggcaccagtggattcgtcagctccaaccagcgcaacaccacagctacccccaccatcatgaaacaaggaagacagaacctgtggtttgccaaccccgggggcagcaatagcatgccaagccgcacccacagctcagtccagaggacccgctcgctgcccgtgcacacttccccacagaacatgctgatgttccagcagccaggttcccaagttcacagtggactgtgtttaacagaccttagaggttggttgagcctgagtggagccccttccatgccagcgctgacagtccccaagtcctcccagggagaattccagcttcccgtgaccgaacctgacatcaacaacaggctggagtcgttgtgcctcagtatgaccgaacacgccctgggagacggggttgaccggacctccaccatctagaagctgaagacgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctggaaaaaaaaaaaaaaaa

SEQ ID NO: 178 - DNA, 4050 bp, Homo sapiens
gaattcggcacgaggtcacccggataggtaaaggaaaacatgcctgccacacggaagccaatgagatatgggcatacagagggacacacggaggtctgttttgatgattctgggagttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgatggatagcagccaacagaaaacatttcgaggacatgatgcccctgttttaagtctttcctttgatcctaaggacatctttctggcatcagctagttgtgatggatctgtcagagtgtggcaaatttcagatcagacatgtgctattagttggccactgctacaaaaatgcaacgatgtgataaatgcaaaatcaatctgcagacttgcttggcagccaaaaagtgggaagttactggcaattcctgtggaaaaatctgttaagctatatagaagagaatcttggagtcatcaatttgatctttcagataatttcatctctcagaccctcaatatagtaacctggtctccctgtgggcaatatttagctgcaggtagtattaatggtctaatcatagtttggaatgtggaaaccaaagactgcatggaaagggtgaaacatgagaaaggttatgcaatttgtggtctggcatggcatcctacttgtggtcgaatatcgtatactgatgcggaaggaaatctagggcttctagagaatgtttgtgaccccagtggaaagacatcaagcagtaaggtatctagcagagtggaaaaggattataatgatctttttgatggagatgatatgagtaatgctggtgattttctaaatgacaatgcagttgagatcccttctttttcaaaagggattataaatgatgatgaggatgatgaagacctcatgatggcttcaggtcgtcctagacagcgaagtcacatcctagaagatgatgaaaactcagttgatatttcaatgctaaaaactggttctagtcttctcaaagaggaggaggaagatggtcaagaaggcagcattcacaatctaccacttgtaacatcccaaaggccattttatgatggacccatgccaactccccggcaaaagccatttcagtcaggttctacaccgttgcatctcactcacagattcatggtgtggaactctattggaattattcgctgctataatgatgagcaagacaatgccatagatgtggagttccatgatacctccatacaccatgcaacacacttatcaaacactttgaattatacaatagcagatctttcccacgaagctattttgttggcatgtgaaagcactgatgaactagcaagcaagcttcactgcctgcactttagttcttgggattcaagcaaagagtggataatagacttgcctcagaatgaggatattgaagccatatgtctcggtcaaggatgggctgctgccgctactagtgccctgcttcttcgattgtttactattggaggggttcaaaaagaggtattcagccttgctggacctgtggtgtcaatggcaggacatggagaacagcttttcattgtttatcacagaggtacaggatttgatggggatcagtgccttggagttcaactgctagagctggggaaaaagaaaaaacaaattttgcatggtgaccctcttcctcttacaaggaaatcctaccttgcatggattgggttttcagctgaaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgcattccttgtaaaggttctcggtttcccccaacccttccacgccctgctgttgctatattatcctttaagcttccttactgtcagattgcaacagagaaaggacaaatggaggagcaattttggcgttcagttatatttcacaaccaccttgattatttagctaaaaatggttatgaatatgaagagagcactaaaaatcaagcaacaaaagagcaacaggaacttttaatgaaaatgcttgcgctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctggttacagcaatactgctacagagtggagccaaccaaggttcagaaatcaagttgaagaagatgctgaggacagtggagaagctgatgatgaagaaaaaccagaaatacataagcctggacagaactcgttttccaaaagtacaaattcctctgatgtttcagctaagtcaggtgcagttacctttagcagccaaggacgagtaaatccctttaaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtgtgggctaacaaagccaaaggagaaacggcaagtgaaggaactgaagcaaagaagcgaaaacgtgtggttgatgaaagtgatgaaacagaaaaccaggaagaaaaagcaaaagagaacctgaatttgtctaaaaagcagaaacctttagatttttctacaaatcagaaactatcagcttttgcatttaagcaggagtaaaggaagaaagtgaccctagggaagtaatggattttttttactcatctttgaatatagactcgagtctttgggaaactcattatatatatattttttaaagagtttgaagcaactgtttgtctttataagataatgtagtaattatattggtgtaggtaacaggacatatgtaaaaactatcatctttgcagattactctgcctccaaatgcagggcctttcagagatgcattgtgattgtaattactgagttgaagctccaaccaatttgaatttgtttcttaaccttgaaaaatcattaaagccaaggtattaaaacctttgtgcattaataccttctaggggtttggttcatttggtttttgtcatgtgcaaggaaggacaatagtcctctttccaagtgtgttagcatagacttctctatatgtttctactagacctaggggatgacgtcttttaataatactggccctaaacatgtaaataatcttgtaggtgagactttttcttttgtgtttcggaaatttcctatgtggctttcagttgtctgtttgtatagcctggatttttttgaggtaaatgaaactttctcatttgtaaaaaaaaaaaaaaaaaactcgag

SEQ ID NO: 179 - DNA, 2861 bp, Homo sapiens
ctggtgctgttgccgccgctgctctagctgccgtcagtcaggctgcgcccgcgtcttcagggcccagtccctcggacccatcgccgcttctagaccctactgcggtctcggatattgccgggaaaatgtctgatgaattttcgttggcagatgcactacctgaacactcccctgccaaaacctctgctgtgagcaatacaaaacctggccaacctcctcaaggctggccaggctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaactgtgccgggccctggccccacagggccatatcctacaccaaatatgccctttccagagctacccagaccatatggtgcacccacagatccagctgcagctggtcctttaggtccatggggatccatgtcttctggaccttgggcgccaggaatgggagggcagtatcctacccctaatatgccatatccatctccaggcccatatcccgctcctcctcctccccaggcccctggggcagcaccacctgttccatggggcaccgttccaccaggagcctggggaccaccagcaccatatcctgcccctacaggatcgtatcccacaccaggactctatcctactcccagtaatcctttccaagtgccttcaggaccttctggtgctccaccaatgcctggtggcccccattcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtataccatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaaggagcacacacatcccttgattcctccctgatgtggtaaactggcacactccaggggtctaaaacataaaacagttgtgtttagggaaccttaagtcatgcagacatgactgttctctttgtacaagtgtgaatcaaaatatgtatctctttttcagagtctggttaagctatgtcattgtctactgcatagtttcctgagtctgtttgtaaagtgcttatggctaacagttcagttctgtatttgttgacaggtaaataagtggagttgagtgccatctttgaaaaaattaccctctagctctaacactgaaaataataataaattgtagatctctgcaactaagtttaaagcagtgtgactgtgttgcttaaatatcaagtattgtttataaccaccaaaaaaaaaagccctggtagttttttggcaccttatgtttaaatcagattcttagatttggagtagacctgaccttgttatttattagataacattttgaatgtatccattggatttctaaaatgtattgtgaatttctcagacaaacaggatttatgctggagctctgttttgcttagaaataaaatatttagtagtttatttctgctctaattaaaatgtcactttacccctggataaaggcactttcactgcctgtcactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtattaaaaaaaaaaaaaaaaaaaaaaaaaa

SEQ ID NO: 180 - DNA, 2979 bp, Homo sapiens
agcaaaccaatcgcaagcctcgttgagtggaaggggtgggatcttccccggaagttttggttaaagcccctccaatcagcggctcggtgcggcaagtttgaatttcgtggaggctcgggttgtgagggttcctgcttcggagtcggcggtggtcgtccagaccgagtgttctttactttttgtttggttgaggtttcacgctagaaggtggctcaggatgtcttcatcacattttgccagtcgacacaggaaggatataagtactgaaatgattagaactaaaattgctcataggaaatcactgtctcagaaagaaaatagacataaggaatacgaacgaaatagacactttggtttgaaagatgtaaacattccaaccttggaaggtagaattcttgttgaattagatgagacatctcaagagcttgttccagaaaagaccaatgttaagccaagggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttgttttcttttatcaaaccagaatgctgtgaaagctgagccaaaaaaggctattccatcttctgtacggattacaaggtcaaaggccaaagaccaaatggagcagactaagattgataacgagagtgatgttcgagcaatccgacctggtccaagacaaacttctgaaaagaaagtgtcagacaaagagaaaaaagttgtgcagcctgtaatgcccacgtcgttgagaatgactcgatcagctactcaagcagcaaagcaggttcccagaacagtctcatctaccacagcaagaaagccagtcacaagagctgctaatgaaaacgaaccagaaggaaaggtgccaagtaaaggaagacctgccaaaaatgtagaaacaaaacccgacaagggtatttcttgtaaagtcgatagtgaagaaaatactttgaattcacaaactaatgcaacaagtggaatgaatccagatggagtcttatcaaaaatggaaaacttacctgagataaatactgcaaaaataaaagggaagaattccttcgcacctaaggattttatgtttcagccactggatggtctgaagacctatcaagtaacacctatgactcccagaagtgccaatgcttttttgacacccagttacacctggactcctttaaaaacagaagttgatgagtctcaagcaacaaaagaaattttggcacaaaaatgtaaaacttactctaccaagacaatacagcaagattcaaataaattgccatgtcctttgggtcctctaactgtttggcatgaagaacatgttttaaataaaaatgaagctactactaaaaatttaaatggccttccaataaaagaagtcccatcacttgaaagaaatgaaggtcgaattgctcagccccaccatggtgtgccatatttcagaaatatcctccagtcagaaactgagaaattaacttcacattgcttcgagtgggacaggaaacttgaattggacattccagatgatgctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcagatagaagatgtaatccacaaattcaacaatctgatcaaacttgaggaatctgggtggcaagtcaataataatatgaatcataatatgaacaaaaatgtctttaggaaaaaagttgtctcaggtatagcaagtaaaccaaaacaggatgatgctggaagaattgcagcgagaaatcgcctagctgccataaaaaatgcaatgagagagagaattaggcaggaagaatgtgctgaaacagcagtttctgtgataccaaaggaagttgataaaatagtgttcgatgctggatttttcagagttgaaagtcctgttaaattattctcaggactttctgtctcttctgaaggcccttctcaaagacttggaacacctaagtctgtcaacaaagctgtatctcagagtagaaatgagatgggcattccacaacaaactacatcaccagaaaatgccggtcctcagaatacgaaaagtgaacatgtgaagaagactttgtttttgagtattcctgaaagcaggagcagcatagaagatgctcagtgtcctggattaccagatttaattgaagaaaaccatgttgtaaataagacagacttgaaggtggattgtttatccagtgagagaatgagtttgcctcttcttgctggtggagtagcagatgatattaatactaacaaaaaagaaggaatttcagatgttgtggaaggaatggaactgaattcttcaattacatcacaggatgttttgatgagtagccctgaaaaaaatacagcttcacaaaatagcatcttagaagaaggggaaactaaaatttctcagtcagaactatttgataataaaagtctcactactgaatgccaccttcttgattcaccaggtctaaactgcagtaatccatttactcagctggagaggagacatcaagaacatgccagacacatttcttttggtggtaacctgattactttttcacctctacaaccaggagaattttgaatttaaaaataaatccaaacattttccttcatattatcaatgcttatatattccttagactattgaaattttggagaaaatgtatttgtgttcacttctatagcatataatgttttaatattctgtgttcatcaaagtgtattttagatatactctttctcaagggaagtggggatattttgtacattttcaacacagaataaaaaatgtactgtgccttg

SEQ ID NO: 181 - DNA, 3423 bp, Homo sapiens
gttttagccaaacaaatgggtttcggggcgagcgttgggcgccgccgcgccgcgctgggtgctcggtccgactcagcggtggggagcgagccaggcctcccgccaccgctgctgccgccaccactgcgtcgggctggtgcagccccgggccaggccgcggccggggcaggagcgcaggggctttgttatgcacctaaagccatattggaagctccagaagaaagagcaccccccggaagtcagcagggaaacgcagagaactcctatgaaccaccaaaaggctgtaaatgatgaaacatgcaaagctagccacataacatcaagtgtctttccttcagcctctctcggtaaagcatcatctcgaaagccatttgggatcctttctccaaatgttctgtgcagtatgagtgggaagagtcctgtagagagcagcttgaatgttaaaaccaaaaagaatgcaccatctgcaacgatccaccagggcgaagaagaaggaccacttgatatctgggctgttgtgaaacctggaaataccaaggaaaaaattgcattctttgcatcccaccagtgtagtaacaggataggatctatgaaaataaaaagttcctgggatattgatgggagagctactaagagaaggaaaaaatcaggggatcttaaaaaagccaaggtacaggtggaaaggatgagggaggttaacagcaggtgctaccaacctgagccttttgcatgtggcattgagcactgttctgtgcactatgtgagtgacagtggggatggagtctatgctgggaggcctctgtcagttatacagatggttgccttcttggagcaaagagccagtgctctgctagctagctgttcaaaaaactgcacaaactcacctgcaattgtgaggttttctggccaatccagaggtgtgcctgcagtgtctgagtcctattctgccccaggagcttgtgaagaacccacagaaaggggaaatcttgaggttggtgaaccacagagcgaaccagtccgtgtccttgacatggtagccaagttggagtctgagtgcctgaagcggcagggccagcgtgagcctgggagcctctcaaggaataacagcttccgtcgaaatgtgggcagagtattgcttgcaaatagcactcaggctgatgaaggcaaaacaaagaaaggcgtcttggaggcacctgacactcaggtgaatcctgtggggtctgtatctgtggattgtggcccttcaagagctgatcgttgttctcctaaggaggaccaggcctgggacggtgcttctcaggactgccccccattgccagcaggagtgagtttccacatagacagtgcagagttagagccgggttcgcaaactgccgtgaaaaacagcaacagatatgatgtggaaatgacagatgaactcgttgggttacctttttcctctcatacctattcccaagcctctgaattgcccacagatgctgttgattgtatgagcagagagcttgtgtcccttactagccgaaatcctgatcaaagaaaagaatctttgtgcattagtatcactgtgtccaaggtagacaaagaccagccttccattttaaactcctgtgaagacccagttccagggatgttgttttttttgccacctggtcagcacttgtcagactattcccagttgaatgaaagcacaacaaaagagtcttcagaggccagccagcttgaagatgctgctgggggtgacagtgcatctgaggaaaaaagtgggtctgctgagccatttgtactgccagcctcttctgtggaaagtacattaccagtgcttgaggcatccagttggaagaagcaggtgtcgcatgacttcctggagaccaggtttaaaatccagcagcttttggagcctcagcagtacatggcttttctgccccaccacattatggtaaaaatcttcaggttacttcccaccaagagtttagtggcccttaaatgtacctgctgctatttcaagtttatcattgagtactacaatatcaggccagcagattctcgctgggttcgagatccacgctatagagaggatccttgcaaacagtgcaagaaaaagtatgtgaaaggggatgtgtccctgtgccgatggcaccccaagccctattgccaggcattgccctatgggccagggtattggatgtgctgccaccggtctcagaaaggattccctggctgtaagctggggcttcatgacaatcactgggttcctgcctgccacagctttaatcgggcaatccataagaaagcaaaagggactgaagctgaagaggaatactaaagtccatgtgagaggcaacaaaaggaccggtttctaaagctgcaaaacacctagatacaccgttcaaatgagcgtagccccctgagtcatcactctagaagaatctgtacatcatcaggactgcattgctcaggcattttctaaactctaaatttacgagctgtacaaaaaaattggtcttgttgtttatagtggcatctcatgtttgaacccgggtggtatcccacagttggattcagttggctgtgaataactgcctgttttcctaaatcaaacccatcctcaaaggatgaagactcaccaccatccaggacattcagaagagttcactgcagatgctgcaggtagtcctcaaaaatgggttccagaaatgttttgagcactggcaacatatttgaaataagtgaatattgtcctgtgaaaagaatagcaggacttttagatgaaaagtattcttaaaaagaaaagtcaggcaccccaccttagacctcgtatgcttgatcctgtgagattgatgtttgtggctggaggtggatttcatgccctgtggtgtttacagtgtatataatggttgtgttttcatggggctatgaaagtgcacgttaaacctgagcgcctttacctttagatgagtgctttggcccctctgtgaatagcacgattaaaatccagttgtatataatggacagctaacggaacaatataatcaccacaatgcagctaggatagtgttgcggctataattttgtgtttttttttttaattgtctagtcttaaatttgtacatcttgtataaaatatgaatgtttcccaaataaactatgaatgtttcctgtataatatatgaatgtttctgagaagaaactctaaatagttgaaaggctaacctgctcaaaggataccaaataatggtttaactggacaacctgaaaattagcatagaaaacaatcctttgttatattttagtgatccacaagattgagaaaatattatatagttagataataacattcttgtctactttatcctgtctggttacaaaattttttaaaacttaaataaaaacatgcatcttaaatggaaaaaaaaaaaaaaaaaa

SEQ ID NO: 182 - DNA, 4816 bp, Homo sapiens
cgtcttcccggtctcctttcccggccgcacagggtagattttcgttccgtcacccaggctggagtgcagtggtgtgaccttggcttgctgcaaccctttgcctcctgggttcaagtgattctcattgcctcagcctcctaagtagctgggattacaggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagctgaaagatctgttgactgaattgcagaaaaaacttgatgattcatattctgaagcagtaagacagaatgaagagctaaatttgttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgatcatcctctggcctaccttgacacatgctctccttcaaaatgctaattcagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaaaaaaaaaaaaaaaaaaaaaaaaa

SEQ ID NO: 183 - DNA, 7596 bp, Homo sapiens
agttccacttccggcgtatgaggcggtgacaatgggagcagcgcgggcggcgccgggaggcagctgacaagcgtttgcggcttcgcttcatggccgctctcccgcccctcctgggatctgtggggagctggggagcccgcagcggcccggagccggagctggcgagccgagcggagacctgtgcgccgcgcctctgaggcgcagcatgtgaagcggagacggcatccagtggggggcgagcctctcagccggccgggatggctaccacggccgagctcttcgaggagccttttgtggcagatgaatatattgaacgtcttgtatggagaaccccaggaggaggctctagaggtggacctgaagcttttgatcctaaaagattattagaagaatttgtaaatcatattcaggaactccagataatggatgaaaggattcagaggaaagtagagaaactagagcaacaatgtcagaaagaagccaaggaatttgccaagaaggtacaagagctgcagaaaagcaatcaggttgccttccaacatttccaagaactagatgagcacattagctatgtagcaactaaagtctgtcaccttggagaccagttagagggggtaaacacacccagacaacgggcagtggaggctcagaaattgatgaaatactttaatgagtttctagatggagaattgaaatctgatgtttttacaaattctgaaaagataaaggaagcagcagacatcattcagaagttgcacctaattgcccaagagttaccttttgatagattttcagaagttaaatccaaaattgcaagtaaataccatgatttagaatgccagctgattcaggagtttaccagtgctcaaagaagaggtgaaatctccagaatgagagaagtagcagcagttttacttcattttaagggttattcccattgtgttgatgtttatataaagcagtgccaggagggtgcttatttgagaaatgatatatttgaagacgctggaatactctgtcaaagagtgaacaaacaagttggagatatcttcagtaatccagaaacagtcctggctaaacttattcaaaatgtatttgaaatcaaactacagagttttgtgaaagagcagttagaagaatgtaggaagtccgatgcagagcaatatctcaaaaatctctatgatctgtatacaagaaccaccaatctttccagcaagctgatggagtttaatttaggtactgataaacagactttcttgtctaagcttatcaaatccattttcatttcctatttggagaactatattgaggtggagactggatatttgaaaagcagaagtgctatgatcctacagcgctattatgattcgaaaaaccatcaaaagagatccattggcacaggaggtattcaagatttgaaggaaagaattagacagcgtaccaacttaccacttgggccaagtatcgatactcatggggagacttttctatcccaagaagtggtggttaatcttttacaagaaaccaaacaagcctttgaaagatgtcataggctctctgatccttctgacttaccaaggaatgccttcagaatttttaccattcttgtggaatttttatgtattgagcatattgattatgctttggaaacaggacttgctggaattccctcttcagattctaggaatgcaaatctttattttttggacgttgtgcaacaggccaatactatttttcatctttttgacaaacagtttaatgatcaccttatgccactaataagctcttctcctaagttatctgaatgccttcagaagaaaaaagaaataattgaacaaatggagatgaaattggatactggcattgataggacattaaattgtatgattggacagatgaagcatattttggctgcagaacagaagaaaacagattttaagccagaagatgaaaacaatgttttgattcaatatactaatgcctgtgtaaaagtctgtgcttacgtaagaaaacaagtggagaagattaaaaattccatggatgggaagaatgtggatacagttttgatggaacttggagtacgttttcatcgacttatctatgagcatcttcaacaatattcctacagttgtatgggtggcatgttggccatttgtgatgtagccgaatataggaagtgtgccaaagacttcaagattccaatggtattacatctttttgatactctgcatgctctttgcaatcttctggtagttgccccagataatttaaagcaagtctgctcaggagaacaacttgctaatctggacaagaatatacttcactccttcgtacaacttcgtgctgattatagatctgcccgccttgctcgacacttcagctgagattgaatttacaaaggaattcagtgtcagttcctttacagaggaatgtcttatacttcagcagccctcggttgatagaaagcacaggagataccttatgacacagccaacattttgtgaaacaatgactggaacaaaacagcagccatacttacctttgaggttttatttaaagtttggataccactagctatattttgcttttttcccctcacattgaattttaattccattcttgaatgtagaaatttcagattctctaaaactacatgtcactgtttttatcctagaaaatgttgctgtcagaaggcaaaggaaatgttaccagtgttttcggttcttgtacttttaacatattccatttagaaattttgccattctgttttccattaataataggtgaaatacaggaaaactacatttgttattcctcagtttttaatgaccttttcagcatcaattgttaatcagattattttaggttttcgtaaataatttttttgcctctttcaaaaggttaacaattaagcatactttctgcagttggttgattggatttttttctgaggtacagcattaatactagtccaaaaaatgtcataaactgaactaaaatgatgaactattttatgtagacattaggagtggatcggaatacttctgctttctgggtaaaacttaaaagtttactatttcttatttggtaaatagattttaagccaattctagtaagaaattaataaaactaccttattttgtatttcacttaaggtggaggaccttaactaaaggaccatatttattcattattttaatattataagggaagtaaaaaaaagtgaggtatagtctaaatggtgcatataggaaatactgacagtgtttagcaacatgcagccctttgagatttctgtcgtaatgctaaacttgaataagatggaatggctgaacatgtggttagtcttttattttaagaagaattgagaattgatagatttggagatgagctttgcaaaggctgtttgcttttcatgtctataggtctgtcattgtcctttttcaaagcatttctgaagttattcctacttggatatagttaatggaattggcttaatttgatgacataataaatcacttataaaattttaaatatcaagtgaaaatttagaaaggccattactattctataaaccttataaacttgctctgggagaatgcattctaaattatatatagtgtttcagctcccattgtggtgttcatagtcttctaggaacagataaacttaagtattcaattcactcttggcattttttctttaatataggctttttagcctatttttggaaaactgcttttcttctgagaaccttattctgaatgtcatcaactttaccaaaccttctaagtccagagctaacttagtactgtttaagttactattgactgaattttcttcattttctgtttagtccagtgttaccaaggtaagctggggaatgaagtataccaacttctttcagagcattttaggacattatggcagctttagaaggctgtcttgtttctagccaagggagagccagcgcaggttttggatactagagaaagtcatttgcttgtactattgccattttagaaagctctgatgtgaattcaaattttacctctgttacttaaagccaacaattttaaggcagtagttttactggccatttaagctctttgtacagtgtcaatttgtaaaaaagaaaaaacgaaaaaaaatctcaaataaaacatgagataacattttaagacttccaaatcagagaagtgcttcaaattattttgtttggattaatttttaaaatgtaaagcatatacttgttgcttagttattttgtttattattttcatgtttgagttctgtgcaatattttctattatgtccgttgataggacagtgacaaaattcgtaagtgaatacttaatttaaaagtgttaacattaatgctcaataaacaaattccctgcagttgttttttttatttcactctttttatattttagagccatccatcctgaattttataaatgattttttatttaaaaatttgagatttttaaaatttttcacagcacaggtcttctcattttcttttttagcaaaaaatacttgactatataaacaagactagaaatttatcctaaacagatggtctttctctgagggaaaaaaaaaaatgtgtcatgtgaggcaatatgcattctttgtattctgattttttaagtgttttcatatttatagccatcacaaaattttgcccaaagtgtatggctcagaagagatgatcaataactaaaatgtttttcgttttgcacatggtaaaattttaggtagagagtggagctttgtataattggtaactttaaccaacatttacgtaagtacggtctttgcagtattacacaataccgcatgagctaatatgcagtatttaggtaatgcattgaatgaagttgaaaatatgctcttaacacactgtgcattgtttttctaaaattgagaaatatctgaaatacagaatacgaatttaataaaggaagcctaccttatgtaaattatgatgttgaaaatgacagtcaaccagagtagatgaagtgtccttatgaagaattattaaatagtagctggatggatctttagatggatgaccacctgaccattccaggacaatttttggtcccattttgaggattgccatagttgcaagtccttaggatcttccttgttttaaaaaactatcaaagtaggttaaattaaaatctaatttaaattaggttaatttatattacattgtagatcattcttttttcccccctctttcacttctaaatattttgctttctaaatactagccttctggttcacagtgaaataatttaattatcaatcagtagattgattccaagtggagaattcactgcttccctaaaatgcgtttttcttacctgtaatggtgaatatttacaaggatctggataaagagattttgatttttgaaatgccacaaaaccccttaaagtggtcaagtacctaaggtagtggctaaggcatgcttgaactgtgtttgagagacagcagttcagtcagtacataatttgttggtgactaacaaagctcacatctgggagattaactttttttaacgcaaaaatattctgcacattacccatatattgttgaattttacatacaaagcattttgtgctttcattcaattagtttaactatattcagtttctgtattatttctctctgatctatcctgtaattattctatactttagaagaaaagatcagttcatattgttagactgaataattctacatgaagttaaaagttagcaatttaaaaaattttgctgcataataaagataattatagttacatgtattgatttaagtctcacacactgtgctaataagtcctttgcacatattattggattctagagcaaccctaggatttgggtactattatttccatttgacagatgaaaaacctaatgcatagaaagataagtagaccagtcaaggtctacagctagtaaaatgctcagattgaaacctaaatcttttctcactcacttttaggttctatatgctattctccttacgtaacgttaaatagatcctttagtttgataggttcattagttttgcttaatcgttgcttccaatatgattcttattgtagtatttatattacaaagttggcatacagggtcaatatctaatttactgttgtgtttttcttaatatgttcaatgtatggtcatactttttaaatttgattttttaaatattataagtggtcatgaaattttaatgttaagtttgtacctaatagaaatatgtctatcacaaatctttattggtattattttatatacttttccagcttgataattttcacaatagaaagagaccaaatattttgtactatattttgtgacatagaagtaaatgacaactctaccttggaagatatgaagaaatcagtgtttttatgttcaaaaactattttaaatgtcataggcttgccaattgtgttaactatttagtacattggtagtttttaaatgactaatgctggagtgaaaatgtaaggcaaaatatttagtatattaacagtagatagtcattttcatgtaatcagaattgcatgttaagggttttaaaagctgtcataactcttaccttttatttctaccagtgatcaatcatttctctttacaaatttagggaggaaacaactgttcaaatgtataggggacagaaacctgacatttagagaacagaaattttaattgccaaattaaagcagctaggctgcccctgggcttaacaaaattcctatttttgaactagacccgaggtattttatcattattatttgataggtaccattaacctttgttttgtgattatcgacttttggggggaaagatgagtaattaaacacactcgcccattttctaagtggtttagaaggttgcagtctgcctcaccatacaaagccagtttaaataggaatatatcacatcatacttcacatagcagtcaacctcagaggaaagtcatttattcagaaggcatagattttgctagacagcagtgatgcattacaaatatataattatttgcactaatatttgagcaggtggaatggattagaacatggtcaacatcatgctgctgataacatgtatttttctatattaatatgtactgtgcaacatgtattaaaattgtcaataattcattttagccaagatactaatatttatattactgtgtttaagagacagtatccaactgagccacttttaatttaaaagtctgaaactggaattaagtttactttcaaaaatcacttaaattactttataatcagtgaaaggtcagtaaaatgtagaattataagtgcctagtgacttaataggaggaaatatggagggttaaggaaggaagtaggaacctggaataagaaagctaagtttcatttatagttccaatgagtgactttctttgttttcaccactgggaatcttaaatgaagaaagtgtcgtatcccttccagttatctttatgttaataaactaagtgaagtttggatagaactaacaaaggaattagtctccattggtggacttccagagtttt

SEQ ID NO: 184 - DNA, 3088 bp, Homo sapiens
cgcgccagggaggttgtcgggaggggccggcgaataaaacgagcggcgaaagaaccgaaaaaaggctcgacgctaccgtgtatgaggaactttgatccttgcgggccaccattccggaagtagaatttagaggaagaaaataccggagttgcagggtataggtaaatttctcaaggttataggttggggttcttagaactttttgtggtgtgtgttggcctagagcgactcagaagcgttagtgacttcacctaaaaaagctaacctctctgctgagcgcgaccggtatgcggcgcaggatgagcctcagggcttctgttaagagtctgtctgagaaagccggtctgcgctgttcctcggtggcgaccttaattatgagatgagctaatgctttactgacttaaccatggcgcagcgggcagtgtggctcataagccacgaaccgggaactccactttgtggcaccgtgagattctccagacggtatccaactgttgaaaaacgagccagagtcttcaatggagcaagttatgtgcctgttcctgaagatggtccctttcttaaagcactgctctttgaacttagattattggatgatgataaagacttcgttgagagtcgtgatagctgttcacgcatcaataaaacatccatttatggactcctgataggaggtgaagaactctggccagttgttgcttttctgaagaatgacatgatatatgcttgtgttccactagttgaacaaactctgtcccctcgtccgccactaattagtgtcagtggagtttcacaaggctttgaatttctttttgggatacaggattttctttattcaggtcaaaaaaatgactctgagctgaatacaaaattgagccagttgcctgacttgcttctgcaggcttgtccatttggtactttattagatgccaacttacagaattcattagataataccaattttgcatctgtgactcagccacagaaacagccagcttggaaaactgggacgtacaaaggaaaaccacaagtttctatttctatcactgaaaaggtaaaatccatgcaatatgataaacagggtatagcagatacatggcaagttgttggaacagtgacttgcaagtgtgatttggaaggaatcatgccaaatgttaccatcagcttgagtctccccaccaatggatctccacttcaggatattctagttcacccttgtgtaacttctcttgactctgcaattctgacttctagtagtattgatgcaatggatgactctgcatttagtgggccttacaaatttccattcactccacctttagagtcattcaacttatgcttctacacttcccaggtccctgccccaccaattttgggtttttatcaaatgaaggaggaagaagtacaactaagaataaccattaatttaaaacttcatgaaagtgtgaaaaataattttgaattctgtgaagcccatatacctttttacaatagaggtccaattacacatttggaatacaaaactagttttggccagcttgaagtatttcgagagaaaagcttattgatctggattattggccagaagttcccaaaatcaatggaaattagtctttctggaactgtaacttttggagccaagagccatgagaagcagccatttgacccaatttgtactggagaaacagcatatttaaagcttcattttaggatcttagattacacacttactggatgttatgcagatcagcattcagttcaagtttttgcatcaggaaaaccaaaaataagtgcacaccggaaactaatttcttctgattattacatctggaattctaaagcccctgctccagtaacatatggatcattattattgtaatagtctcatgtttaaatgggattatataatgataacagtttaaagaaaatcataatcttatatttttaatgtggatgcatataacctgtgagtgaaaaatcactgaatgatttaattgtaaaagtagtcttatgtggtgtttgtagtctgatagagcttgaaaggacattttaaaagctaatgtctccaattttgtcaaccttcgattttatgccagtataattcagaacatagaaaagtaatgattcacttgggctcattttagactggtcctgggtcaccctgccacacttgtttcctagtgtttctgtggcagacattgctaatcaattacagcccttttctgtactgagccttggataaagggtcaggctcctttttagttcagagattcaggcagccactcccagtgggttgtagataatgtgcaagataaaaactattttctcttccaaatctaagtactaagctcctagtataaggtgttgttacagaataccagagaccatgttagagacaactacatctcttcaaaaaacagccaacagagacaaaggaaaagtgtttaaatagtaagctgttcttcttaatcagaactatcctattgactaataaataatctgcataattctacttaaggtgtgtaatctctgttctagagttagtttttaagtaagcttgttaatctgccactttgacattttgcttaggatgtcagtagccatattaagatgtgtagaataccttcagaagatgatcatagtgttttgtaatcatttaatgtctgcagccaaatttttaaaggtaatttagacctaatactgctcttgctgtgtcttattaagttaaaattaatgaatgaattctggtaaaaattcaaaaggcactctgtgagtagagagtatcatttaagcttattttagtcacatgtagtatatatctccttaaagctgtcactctcactttcttaccattctcttgatttcttcagaaaccatctagtcatcatctttatactctacctgcttctgcaattatatatcatattatgttttcagagcagttcattgtcaagttggactttaagtgaccattcaagaaaagatgaaatctcacgaacctcaaaacttcattcatgtctttttacaaatgagaaaaaaaaatgcattaaagattaatactcaatttgaaaaaaaaaaaaaaaaaaaa

SEQ ID NO: 185 - DNA, 1621 bp, Homo sapiens
gccccggccccgccccgcgagcgccgagacttgttggccgcggagactgcgaccctcttctctcagtctgccttactaccatgccgctctacgagggcctggggagcggcggggagaagacggcggtcgtgatcgacctgggagaggcctttaccaagtgtggatttgctggagaaactggtccaagatgtataattcctagtgtgataaaaagagctgggatgcctaagcctgtcagagttgttcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgaggttccatctgtcttgcttgctccaagtcatctaatggctcttctgacgcttggaattaattctgccatggtcctagattgtggatatagggaaagcctggtgttacccatatatgaaggaatcccagttctaaattgttggggagcactacccctaggaggaaaagctcttcacaaagagttggaaactcaactattggaacaatgtactgttgacacaagtgttgctaaagaacagagccttccctcagtgatgggttcagttccggaaggtgtcttagaggacattaaagcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagcaagcagtttgattttggaaaaaaaaaaaaaaaaaaaaaaaaaaaaaaaa

SEQ ID NO: 186 - DNA, 1926 bp, Homo sapiens
ccacgcgtccgattctgatgccaggaatgttctatcaggcataattgattctcatgaaaacttaaaagaatttaaaggtgacctcattaaagtacttgtgtggatacttgttcaatactgctccaaaaggcctggcatgaaagagaatgttcacaacactgaaaataaagggaaagcacctctaatgttgcctgctttgaacactttgccacctcccaaatccccagaagacatagacagtttaaattcagaaacttttaatgactggtctgatgataatatttttgatgatgagccaactatcaaaaaagtaatagaagaaaaacatcagttgaaagatttgccaggtacaaatttgtttattccaggatcagtagaatcacagagggttggtgatcattctacaggcactgttcctgaaaacgatctttacaaagcagttctattaggataccctgctgttgacaaaggaaaacaagaggacatgccatatattcctctcatggagttcagttgttcacattctcacttagtatgcttacccgcagagtggaggactagctgtatgcccagttccaaaatgaaggagatgagctcgttatttccagaagactggtaccaatttgttctaaggcagttggaatgttatcattcagaagagaaggcctcaaatgtactggaagaaattgccaaggacaaagttttaaaagacttttatgttcatacagtaatgacttgttattttagtttatttggaatagacaatatggctcctagtcctggtcatatattgagagtttacggtggtgttttgccttggtctgttgctttggactggctcacagaaaagccagaactgtttcaactagcactgaaagcattcaggtatactctgaaactaatgattgataaagcaagtttaggtccaatagaagactttagagaactgattaagtaccttgaagaatatgaacgtgactggtacattggtttggtatctgatgaaaagtggaaggaagcaattttacaagaaaagccatacttgttttctctggggtatgattctaatatgggaatttacactgggagagtgcttagccttcaagaattattgatccaagtgggaaagttaaatcctgaagctgttagaggtcagtgggccaatctttcatgggaattactttatgccacaaacgatgatgaagaacgttatagtatacaagctcatccactacttttaagaaatcttacggtacaagcagcagaacctcccctgggatatccgatttattcttcaaaacctctccacatacatttgtattagagctcattttgactgtaatgtcatcaaatgcaatgtttttattttttcatcctaaaaaagtaactgtgattcttgtaacttgaggacttctccacacccccattcagatgcctgagaacagctaagctccgtaaagttggttctcttagccatcttaatggttctaaaaaacagcaaaaacatctttatgtctaagataaaagaactatttggccaatatttgtgccctctggactttagtaggctttggtaaatgtgagaaaacttttgtagaattatcatataatgaattttgtaatgctttcttaaatgtgttataggtgaattgccatacaaagttaacagctatgtaatttttacatacttaagagataaacatatcagtgttctaagtagtgataatggatcctgttgaaggttaacataatgtgtatatatttgtttgaaatataatttatagtattttcaaatgtgctgatttattttgacatctaatatctgaatgtttttgtatcaagtagtttgttttcatagacttcaattcataaactttaaaaaacttttaataaaatattttccttccttttcaaaaaaaaaaaaaa

SEQ ID NO: 187 - DNA, 3629 bp, Homo sapiens
agcgggaagagacgcttggggctggggctcaccggacgggtaggtccggctctccagggagaggagctgcccggccctggagaaggggcgagtcctgcgcgagtccccgggaggcgccgcgcgcttggaagggacggtcgggcttccccggcccgctgagggctaggcggcgggctcccctcctttccacctcggcagggagggaaggaggggagggaaaagtcccacggaggaggcagaatggccagtcgaggggcgcttaggcgctgcctttccccagggctgcctcgactcctgcacctgtcccgagggctggcctgagacgggactcccggttctcccgctgcgaagcagcgcggccccccggggccggggcagcggcgccggcatgtcgtctggcaccatgaagttcaatggctatttgagggtccgcatcggtgaggcagtggggctgcagcccacccgctggtccctgcgccactcgctcttcaagaagggccaccagctgctggacccctatctgacggtgagcgtggaccaggtgcgcgtgggccagaccagcaccaagcagaagaccaacaaacccacgtacaacgaggagttttgcgctaacgtcaccgacggcggccacctcgagttggccgtcttccacgagacgcccctgggctacgaccacttcgtggccaactgcaccctgcagttccaggagctgctgcgcacgaccggcgcctcggacaccttcgagggttgggtggatctcgagccagaggggaaagtattcgtggtaataacccttaccgggagtttcactgaagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcccacacaagttcagcatccacaactacaaagtgccaacattctgcgatcactgtggctcactgctctggggaataatgcgacaaggacttcagtgtaaaatatgtaaaatgaatgtgcatattcgatgtcaagcgaacgtggcccctaactgtggggtaaatgcggtggaacttgccaagaccctggcagggatgggtctccaacccggaaatatttctccaacctcgaaactcgtttccagatcgaccctaagacgacagggaaaggagagcagcaaagaaggaaatgggattggggttaattcttccaaccgacttggtatcgacaactttgagttcatccgagtgttggggaaggggagttttgggaaggtgatgcttgcaagagtaaaagaaacaggagacctctatgctgtgaaggtgctgaagaaggacgtgattctgcaggatgatgatgtggaatgcaccatgaccgagaaaaggatcctgtctctggcccgcaatcaccccttcctcactcagttgttctgctgctttcagacccccgatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctatagagatctgaaactggacaatgtcctgttggaccacgagggtcactgtaaactggcagacttcggaatgtgcaaggaggggatttgcaatggtgtcaccacggccacattctgtggcacgccagactatatcgctccagagatcctccaggaaatgctgtacgggcctgcagtagactggtgggcaatgggcgtgttgctctatgagatgctctgtggtcacgcgccttttgaggcagagaatgaagatgacctctttgaggccatactgaatgatgaggtggtctaccctacctggctccatgaagatgccacagggatcctaaaatctttcatgaccaagaaccccaccatgcgcttgggcagcctgactcagggaggcgagcacgccatcttgagacatcctttttttaaggaaatcgactgggcccagctgaaccatcgccaaatagaaccgcctttcagacccagaatcaaatcccgagaagatgtcagtaattttgaccctgacttcataaaggaagagccagttttaactccaattgatgagggacatcttccaatgattaaccaggatgagtttagaaacttttcctatgtgtctccagaattgcaaccatagccttatggggagtgagagagagggcacgagaacccaaagggaatagagattctccaggaatttcctctatgggaccttcccagcatcagccttagaacaagaaccttaccttcaaggagcaagtgaagaactctgtgaaggatggaactttcagatatcaactatttagagtccagagggagccatggcactagaaatagttgataatgaaatgagattttatgaagtataccgctccacctatgagcgtctgtctctgtgggcttgggatgttaacaggagccaaaaggagggaaagtgtgaagaataaagtagatctgagaaattctgagccaatcaggcttcttaattcaagagacaaaccaagacgttctgtcaactgtgctgtgctcttctttaagccaatgaaccccaattcctggcagtctacaagaagtctcttaatgctaatgaagaatttaaaggtctttttaaggaaatgaagggctttccaaatagaatgatttactctgaagaaacaaacaatggtatctctgaaactcacaacctaaagcccaatcttgaaaatatgttgtgcaccaagacgactgcttcagcttcttctcttatccttactttctttaatagatatttattaaactgtccagtgaaaaggtgccacaatgcccagtattgtaaacaacaggtttgcattcatgaagctttcattcattctggagtctactaatttacctgaatggtgtttgcattctgtgaaatgcctctccacgttgcatatgtcacacttttgtctgcacataactcttttttcacaagaagggtcactgccacaacagcacagtcagcgggtgaattacaggtgcctgctgcctgcctacctgggtaatctgatcttgtctgtatcgccgtgtgctcatcactgaagaattgcaggccactcatgtcagtgaccagatttgtggcttataaacattagcagtttatttatgttttaagatgcaaagatgtgtgtttgatattcactttaataattagaaatggatcttgtaaacagggcatatatcaaagatgaccttataatatgtacccgaatatacagttcaagaattttgtctgactggaaataaatgcattttgtagcaaaaaaaaaaaaaaaaaaaaaaaaaaaaaaaaaaaaaaaaaaaaaaaa

SEQ ID NO: 188 - DNA, 3958 bp, Homo sapiens
gtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccaggaaaaaaaaaaaaaaaaaaa

SEQ ID NO: 189 - DNA, 3812 bp, Homo sapiens
gtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 190 - DNA, 2594 bp, Homo sapiens
gcttcgggtgccatggggactcctcccggcctgcagaccgactgcgaggcgctgctcagccgcttccaggagacggacagtgtacgcttcgaggacttcacggagctctggagaaacatgaagttcgggactatcttctgtggcagaatgagaaatttagaaaagaacatgtttacaaaagaagctttagctttggcttggcgatattttttacctccatacaccttccagatcagagttggtgctttgtatctgctatatggattatataatacccaactgtgtcaaccaaaacaaaagatcagagttgccctgaaggattgggatgaagttttaaaatttcagcaagatttagtaaatgcacagcattttgatgcagcttatatttttaggaagctacgactagacagagcatttcactttacagcaatgcccaaattgctgtcatataggatgaagaaaaaaattcaccgagctgaagttacagaagaatttaaggacccaagtgatcgtgtgatgaaacttatcacttctgatgtattagaggaaatgctgaatgttcatgatcattatcagaacatgaaacatgtaatttcagttgataagtccaagccagataaagccctcagcttgataaaggatgatttttttgacaatattaagaacatagttttggagcatcagcagtggcacaaagacagaaagaatccatccttaaagtcaaaaactaatgatggagaagaaaaaatggaaggaaattcacaagaaacggagagatgtgaaagggcagaatcattagcgaaaataaaatcaaaggccttttcagttgtcatacaggcatccaaatcaagaaggcatcgtcaagtcaaactcgactcttctgactctgattctgcatctggtcaagggcaagtcaaagcaactaggaaaaaagagaagaaagaaagattgaaaccagcaggaaggaagatgtctctcagaaacaaaggcaatgtgcagaatatacacaaggaagataaacctttaagtctgagtatgcctgtaattacagaagaagaagagaatgaaagtttgagtggaacagagttcactgcatccaagaagaggagaaaacactgaacaaagagcctggtgtagtttttaattttgagttttctgacagaagaaaagattgatattttgtgtattgaacaggaagactgccagtattaaaaaaatccttctgggaatctgtaggttatttcttggaaattgcaatacgtagttctagaataaaagtacaaaaaattagaataagaattctttaacattttctttaatgatttgcataaatggagataaaacttgtatttagtatgtaatagaaaaaattctgttattcgcagattgttactatttcctataaggttttgtgatactatactgtcctaatacagtctggtaatactattctattttatttaaaatattttttattgaaatattaatgtttattacatgcaaataactattttgtatctacagtcggataatggattttttattttgtatatttattctattttgtatattgttaagtgcaataaagtttttgccttgctttattttttaatacataaaacttacattctcataacgtgattgataacttaggaagttcacaatgtattttctacttctgcaattaaatattctttagtgcttgtttattattactaaatactaattaagtactaacaagtacttaaatactaatgtattaagtatttaagtactttctaataaaatctttaacaataataatgtaaatttcagaatgtgtctctggtacagaatagttgatattaacagaaaaaaaaaaatctgtagcttcatgaatatgccactctgttaatttcttgttccagacattttaatagagattgcttgagccatgttgtttgaattgctgccaatagcagaccatatccctatcatgttgttggctcaactgttttttttttttccctaatagagatggagtatcgctatgttgctcaggctggtcttgaactcctgggctcaagctatcctcctgcctcagcctcccaaagtactgggattataggtgtgagctactgtacccagccttaacctgtttcacagttgattatacttcatgctgttttccagcatggtattattaagggatttaaagtttgggttgcatgcctgtaatcccagcattttgggaggccgaggtgggcggatcacgaggtcaggagatcgagaccatcgtgactaacacagtgaaaccccgtctctaataaaaatacgaaaaattagccaggcgtggtggcgggcgcctgtaatcccagctactcgggaagctgaggcaggagaatggtgtgaacccagtgagccgagatcgtgccactgcactccagcctgggcaacagagtgagacttcgtctcaaaaaaaaaaaaaaaagtttgggttgaagatcaaattcgtgatatctctatatctaatctttaaaaatcagaatgctaatgctgacgcaaataaaattttcatttattagcaaaaaaaaaaaaaaaaaaaaaaaaaaaaa

SEQ ID NO: 191 - DNA, 4119 bp, Homo sapiens
cgcagaaacttgttgcaacaaacaggcgaccgcgggtgcccctagcagccagcggcagagtgggtgggcgggcgagagggaggggaaggctggcggacgccgcagcgaactggtgggcagacccggagtcgccgcgtaagcggggccggctcagtgcggtgcggcaggcgcggctgtgcggcagcggaagtcctttgttgcagcacagtccctggcagagccagagcctctccgcgcagcccagcccgagcgccgagcgccgcgcgccgccgccactgcagctcgcggccccttcgccttcgcccgcctttcccgcggctgatttgccttaaactccctaaaatctccgcagctctggttcctgttgcggccggtctctaattaacagaagatggcaaagcccagccacagcagctatgtccttcagcagctaaacaaccaaagagaatggggttttctctgtgactgctgtattgcaattgatgacatttactttcaagcacacaaggcagttctagctgcctgtagctcctattttagaatgtttttcatgaaccatcagcatagtactgcacaactgaatctcagcaacatgaaaattagtgcagaatgttttgatctcattttgcagtttatgtatttaggaaaaattatgacagctccctccagttttgagcagtttaaagtggcaatgaactacctacagctatacaatgttcctgactgtttagaagacatccaggatgcagattgttctagttcaaaatgttcctcttctgcttccagcaaacagaacagcaaaatgatatttggggtaagaatgtatgaagatactgtggctcgaaatggcaatgaagccaacaggtggtgtgcagagccaagttcaacggtaaatacaccacataatagagaggctgatgaagagtctttacaattaggtaattttcctgagccactatttgatgtatgtaaaaaaagttccgtgtccaaattatctactccaaaagaacgtgtgtcaagacgctttgggcggagttttacctgtgatagctgtggatttggctttagctgtgaaaaattattagatgagcatgtgctaacctgtactaacagacatttataccaaaacacaagatcttaccatagaatagtagatattagagatggaaaagacagtaacatcaaagctgaatttggtgaaaaagattcttccaaaacattttctgcacagacggacaaatacagaggagacacaagccaggctgctgatgattcagcttcaaccactggaagcagaaaaagtagcacagtggagtctgaaatagcaagcgaagagaaaagcagagctgctgagaggaaaaggattattattaagatggagccagaagatattcctacagatgaactgaaagactttaacattattaaagttactgataaagactgtaatgaatccactgacaatgatgaattagaagatgaacctgaagagccattttatagatactatgttgaagaagatgtcagcataaaaaaaagtggtaggaaaactctaaaacctcgaatgtcagtaagtgctgatgaaagaggtggtttagagaatatgaggccccctaacaacagcagtccagtacaagaggatgctgaaaatgcatcttgtgagctgtgtggacttacaataaccgaggaggacctgtcatctcattacttagccaaacacattgaaaatatctgtgcatgtggtaaatgtggacaaatacttgtaaagggtaggcagcttcaggaacatgctcaacgatgtggcgagccccaagatctgaccatgaatgggttaggaaatactgaggagaaaatggacttggaagagaatcctgatgagcagtccgaaataagagatatgtttgttgaaatgctggatgattttagggacaatcattaccagataaacagtatccaaaaaaagcagttatttaaacattctgcctgcccttttcgatgtcctaattgtggccagcgttttgaaactgaaaatctagtggttgaacatatgtctagctgcttagatcaagatatgtttaagagtgccatcatggaagaaaatgaaagagatcacagacgaaagcatttttgtaatctgtgtggaaaaggattttatcagcggtgtcacttaagagaacactatactgttcatactaaggaaaaacagtttgtttgtcaaacatgtggaaagcagtttttaagagagcgtcagttgcgactgcacaatgatatgcacaaaggcatggccagtggtgaaatagggccttctaaacctgtggagaagtgagagatctgaatttggagaggacatggggaagaatcaatcttcaacagataatctttaagtacagacccaggaatatcagatctgaagtggcaccatcttttctgtcttcctgacaaacttccatcaacccaaaaagttccagttgcaaagatccaagaaaactcagtaaagatcactttggaatcactttgttgtaacaaaattgattcatggtgactctaatatttgtgtaaatctgctgaagaaaagtaactagaaaattcatacaacatcagtggttacagctatactaaaataaaactttatatgctaattatcttcaagggtctttctaaaataaaaggggttgttaggctactgcaaatataaagagacataatcacaaatctatttatatagatataaataattctaaacttaaaatcactagaattatagcttaaatattatgaaatgtacttagtcaacttaaaaacttacaccaaaaatctgtagtttagagtgtaagaagtaatgggtacagagaaaaaaaatttaagaccaatattttaacaggataatttggttattactcactatagtaaaacacttgcccttcttccttttccactgtatatgccagtcacaatcttgatcatttatatgaatgaaactcccttttaaacctgttaacttgaaggagaacagaaatggtattacttcaatagtggtagatttccacaaatcagacacattattttcttctgaacttggcaatataacctaataaggcagaataagtttctgttaaaatacttattctcaatatttatgtataaaccatgcttctcagctttcaaatttcaagataaaatttaagtattcagtaaaatgatggttaacatgttttaaaaaatctttaatggagaagttaaatatttggtgagattttagtctggctataaatgctttgtttgatatatatatgtgcacatatatatattacttaaccatatgaattttatttccttattctgaatatacttgtagttttacttctttctgtttatgtacccaattccttatgattattttgtttcttctgcaatatcaagatgttatttattttgagaaatgcttatttttatgactatttattccaatgttttaacaagaagcacagagatttatagtattcttaatagtatgtgcagaagttacatcatttaaaaaacccttgctgtaaagtaggataacttgaatattcattctaataattagactaagtgaaaatctgagaaagagttaattgcaatgtgatagtgggtagaaaggagagaaaaacccactgaagggttcaaatacatgtgaattctactgctttaagagaaataaaacaaataagcctagggaaatattagagtctaaaaaaccctagagttaatctcttttgggaacataaggaggtatacagaactgcagacctctaaacataagtaggaaaaagaaaaataaaagaatattaccaataattaaaggtgccagatcaaaatagtaataaatcaacaaataatttttgattgactggtggaattagatttactaaataaaaatggcttaaattttgactgtactaactataaatgtaatgaattataataattataaatggtataaatgcattctacaatgtgattattttctgtattttagtatatagtataaaatggaattattgggttaaagtacttttattacatttcttaatccattgtttttacctaataaaatttcctcctctatattccaaagtt

SEQ ID NO: 192 - DNA, 2425 bp, Homo sapiens
gctccggacgcgaggggcggggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaa

SEQ ID NO: 193 - DNA, 2145 bp, Homo sapiens
cagcatcaccatgtctgttcgatacagctcaagcaagcactactcttcctcccgcagtggaggaggaggaggaggaggaggatgtggaggaggaggaggagtgtcatccctaagaatttctagcagcaaaggctcccttggtggaggatttagctcaggggggttcagtggtggctcttttagccgtgggagctctggtgggggctgctttgggggctcatcaggtggctatggaggattaggaggttttggtggaggtagctttcgtggaagctatggaagtagcagctttggtgggagttatggaggcagctttggagggggcagtttcggaggtggcagctttggtgggggcagctttggtggaggcggctttggtggaggcggctttggaggaggctttggtggtggatttggaggagatggtggccttctctctggaaatgaaaaagtaaccatgcagaatctgaatgaccgcctggcttcctacttggacaaagttcgggctctggaagaatcaaactatgagctggaaggcaaaatcaaggagtggtatgaaaagcatggcaactcacatcagggggagcctcgtgactacagcaaatactacaaaaccatcgatgaccttaaaaatcagattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggctacggcggcggaagctccggcggcggaagctccggcggcggctacggcggcggccacggcggcagttccggcggcggctacggaggcggaagctccggcggcggaagctccggcggcggctacgggggcggaagctccagcggcggccacggcggcagttccagcggcggctacggtggtggcagttccggcggcggcggcggcggctacgggggcggcagctccggcggcggcagcagctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgttttgtggtttctgtatttcttcttttcactttaccagaaagtgttctttaatggaaagaaaaacaactttctgttctcatttactaatgaatttcaataaactttcttactgatgcaaactaaaaaaaaaaaaaaaaaaaaaa

SEQ ID NO: 194 - DNA, 4450 bp, Homo sapiens
agccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcatccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagatctcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 195 - DNA, 4420 bp, Homo sapiens
agccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcatccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagatctcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 196 - DNA, 2492 bp, Homo sapiens
gcggcgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaaaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaaaaaaaaaaaaaaaaaaaaaaaaaaaaa

SEQ ID NO: 197 - DNA, 1674 bp, Homo sapiens
gagcggctgaaaggcggaagtggaggccggagcctgggacaccgccggcggggagagaagcggatcccgtccgagccccggccccaagtaacgccgccgccccggagccgccttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagccccaacatcgtcattgcactcgcgggtaacaaggcagacctggccagcaagagagccgtggaattccaggaagcacaagcctatgcagacgacaacagtttgctgttcatggagacatcagcaaagactgcaatgaacgtgaacgaaatcttcatggcaatagctaagaagcttcccaagaacgagccccagaatgcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccaccactgggggggcagggggaggggtccaccatgatttctccatataattttgatcataggccggagtgagtcattccacctgcacctttctgtacaaatactaattcaattttaagtcttaagtcacttttttaatatatatgatcttctgctcttcccacttcctcccctttctactgctctcccattttcccttgctgggagtagccacatgctcttgccccccaacccttgtatatggggacagtggggtcagtgcagctaccctttctttccctcctgcggaacagcggacccagcaagagcatccacatcctcactttgttcggagtggtctttggtttgggcggtggggcagaccttgggaaggggcttaggaagggagaggcagctcttccttcagctggctctcatcaggctgcagccccctccccgctcccacctccctgctgggaaaccacagcattatcacagcattattgtgacagccacgaacccattgcccacaacccctccaccctcggtcaccccaacctctggctctgagccctgttctgaccaaatcatgatgatgagtatttgggggtgggtgggtaagggggggagtgggaggggacggaaccaactttttctgtattttgtattgtatgttttcttcaacatgtaaccaatcagtatcttgtcaatatagtcagccgatcgatcgacctcaaaaaaaaaaaaaaaaaaaa

SEQ ID NO: 198 - DNA, 1791 bp, Homo sapiens
gagcggctgaaaggcggaagtggaggccggagcctgggacaccgccggcggggagagaagcggatcccgtccgagccccggccccaagtaacgccgccgccccggagccgccagtctcgctctctcgccaggccggagtgcagtggcactatctcagctcagtgcaacctctgcctcccgggttcaagcgattctcctgcctcagcctcccgagtagctgggactacagttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagccccaacatcgtcattgcactcgcgggtaacaaggcagacctggccagcaagagagccgtggaattccaggaagcacaagcctatgcagacgacaacagtttgctgttcatggagacatcagcaaagactgcaatgaacgtgaacgaaatcttcatggcaatagctaagaagcttcccaagaacgagccccagaatgcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccaccactgggggggcagggggaggggtccaccatgatttctccatataattttgatcataggccggagtgagtcattccacctgcacctttctgtacaaatactaattcaattttaagtcttaagtcacttttttaatatatatgatcttctgctcttcccacttcctcccctttctactgctctcccattttcccttgctgggagtagccacatgctcttgccccccaacccttgtatatggggacagtggggtcagtgcagctaccctttctttccctcctgcggaacagcggacccagcaagagcatccacatcctcactttgttcggagtggtctttggtttgggcggtggggcagaccttgggaaggggcttaggaagggagaggcagctcttccttcagctggctctcatcaggctgcagccccctccccgctcccacctccctgctgggaaaccacagcattatcacagcattattgtgacagccacgaacccattgcccacaacccctccaccctcggtcaccccaacctctggctctgagccctgttctgaccaaatcatgatgatgagtatttgggggtgggtgggtaagggggggagtgggaggggacggaaccaactttttctgtattttgtattgtatgttttcttcaacatgtaaccaatcagtatcttgtcaatatagtcagccgatcgatcgacctcaaaaaaaaaaaaaaaaaaaa

SEQ ID NO: 199 - DNA, 5171 bp, Homo sapiens
ggcgggaggagagtcggcggccggagccgtcaccccgggcggggacccagcgcaggcaactccgcgcggcggcccggccgagggagggagcgagcgggcgggcgggcaagccagacagctgggccggagcagccgcgggcgcccgaggggccgagcgagattgtaaaccatggctgtgtggatacaagctcagcagctccaaggagaagcccttcatcagatgcaagcgttatatggccagcattttcccattgaggtgcggcattatttatcccagtggattgaaagccaagcatgggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccagaacacgtatgaccgctgccccatggagctggtccgctgcatccgccatatattgtacaatgaacagaggttggtccgagaagccaacaatggtagctctccagctggaagccttgctgatgccatgtcccagaaacacctccagatcaaccagacgtttgaggagctgcgactggtcacgcaggacacagagaatgagttaaaaaagctgcagcagactcaggagtacttcatcatccagtaccaggagagcctgaggatccaagctcagtttggcccgctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacgttcatcattgagaagcagcctcctcaggtcctgaagacccagaccaagtttgcagccactgtgcgcctgctggtgggcgggaagctgaacgtgcacatgaaccccccccaggtgaaggccaccatcatcagtgagcagcaggccaagtctctgctcaagaacgagaacacccgcaatgattacagtggcgagatcttgaacaactgctgcgtcatggagtaccaccaagccacaggcacccttagtgcccacttcaggaatatgtccctgaaacgaattaagaggtcagaccgtcgtggggcagagtcggtgacagaagaaaaatttacaatcctgtttgaatcccagttcagtgttggtggaaatgagctggtttttcaagtcaagaccctgtccctgccagtggtggtgatcgttcatggcagccaggacaacaatgcgacggccactgttctctgggacaatgcttttgcagagcctggcagggtgccatttgccgtgcctgacaaagtgctgtggccacagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtctgtgtcctggtcccagttcaacagggagaatttaccaggacggaattacactttctggcaatggtttgacggtgtgatggaagtgttaaaaaaacatctcaagcctcattggaatgatggggccattttggggtttgtaaacaagcaacaggcccatgacctactcattaacaagccagatgggaccttcctcctgagattcagtgactcagaaattggcggcatcaccattgcttggaagtttgattctcaggaaagaatgttttggaatctgatgccttttaccaccagagacttctccattcggtccctagccgaccgcttgggagacttgaattaccttatctacgtgtttcctgatcggccaaaagatgaagtatactccaaatactacacaccagttccctgcgagtctgctactgctaaagctgttgatggatacgtgaagccacagatcaagcaagtggtccctgagtttgtgaacgcatctgcagatgccgggggcggcagcgccacgtacatggaccaggccccctccccagctgtgtgtccccaggctcactataacatgtacccacagaaccctgactcagtccttgacaccgatggggacttcgatctggaggacacaatggacgtagcgcggcgtgtggaggagctcctgggccggccaatggacagtcagtggatcccgcacgcacaatcgtgaccccgcgacctctccatcttcagcttcttcatcttcaccagaggaatcactcttgtggatgttttaattccatgaatcgcttctcttttgaaacaatactcataatgtgaagtgttaatactagttgtgaccttagtgtttctgtgcatggtggcaccagcgaagggagtgcgagtatgtgtttgtgtgtgtgtgtgtgtgtgtgtgtgtgtgcgtgtttgcacgttatggtgtttctccctctcactgtctgagagtttagttgtagcagaggggccacagacagaagctgtggtggtttttactttgtgcaaaaaggcagtgagtttcgtgaagcctggaagttggccatgtgtcttaagagtggctggactttgacatgtggctgtttgaataagagaaggacaaagggaggagaaagcacatgtgctccagtgagtcttcgtcactctgtctgccaagcaattgatatataaccgtgattgtctctgcttttcttctgaaatgtagataactgctttttgacaaagagagccttccctctcccccacccctgtgttcttgggtaggaatgggaaaaggggcaacctacaaagattgttggggcaagggaagtcacaagctttcggatgggcggtggcttttcacaaaacatttagctcatcttattctctctttgtcctctctcccctcctgcccgcccgcaccctggaattgccactcagttcctctgggtgtgcacatatgtttggagaaatagaggagagaaaagagggccacgtaactgagagcttacagtgccaatgccgtttgtgttctggccagagtggagtgcgcagccctgactcccaggcgctgagattgttgcctggttacccaggaagctgctgttccggctgcccagcctttctctgagccagcggatgcacagtccgtggccttcttcaggcttattgatgatgctttttgcaaatgttgaatcatggttctgtttctaagttggatcttttttgttttctccttgccaccctaatttgacatcaaaattctctcttgtgcattgggccctgggtcattcaaacccaggtcacctcattccccttctctgttcacacctaatgtcttgaagagtaggtagcagcagtgtgggctgaacctaggccagcttgcttagcgggtcaccctgctgtgaagtcctggcaggtgttggtaatgtgtggaaatgcagtcagcaagtttgctggggagtttgataaaagtataaaacaaaacaaaaaaagcctcggtataattttgttccacgacttcttctgtagctttacaccagaaggaaggaatgggctacagcaggtagtggaggaagaggggggtgagcaggtgtattaaaatagcttacgggtaaggcctaaaaggtcacccctcggccccctctccaaaagaagggcatgggcacccccaggagaggatggccccaaaaaccttatttttatacatgagagtaaataaacatattttttttacaaaaataacttctgaatttatcagtgttttgccgttaaaaatattcctctatagtaaattatttattggaagatgacttttttaaagctgccgtttgccttggcttggtttcatacactgatttatttttctatgccaggcagtagagtctctctgcctctgaggagcaggctacccgcatcccactcagcccctccctacccctcaagatttgatgaaaattccaaccatgaggatgggtgcatcggggaagggtgagaaggagagcctgcctgctcagggatccaggctcgtagagtcactccctgcccgtctcccagagatgcttcaccagcacctgcctctgagacctcgctctctgttccagcaaccctggttggggggtcagacttgatacactttcaggttgggagtggacccaccccagggcctgctgaggacagagcagccaggccgtcctggctcactttgcagttggcactgggttggggaggaagagagctgatgagtgtggcttccctgagctggggtttccctgcttgtccagttgtgagctgtcctcggtgttaccgaggctgtgcctagagagtggagatttttgatgaaaggtgtgctcgctctctgcgttctatcttctctctcctccttgttcctgcaaaccacaagataaaggtagtggtgtgtctcgaccccatcagcctctcacccactcccagacacacacaagtcctcaaaagtttcagctccgtgtgtgagatgtgcaggttttttctagggggtagggggagactaaaatcgaatataacttaaaatgaaagtatactttttataatttttctttttaaaacttggtgaaattatttcagatacatattttagtgtcaaggcagattagttatttagccaccaaaaaaaagtattgtgtacaatttggggcctcaaatttgactctgcctcaaaaaaaagaaatatatcctatgcagagttacagtcacaaagttgtgtattttatgttacaataaagccttcctctgaagggaaaaaaaaaaaaaaaaaaaaaaaaaaaaaaaaaaaaaaaaaaaaaaaaaaaaaaaaaaaaaaaaaaaaaaaaaaaaaa

SEQ ID NO: 200 - DNA, 4139 bp, Homo sapiens
ggcggcgcaggggcggggctttacggacgcaagcacgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcacccatctagactttgagttccctgcatctgccaccgtagtttctagcaggagtagtggggggagtaatacagattcttccctagaaggggacactggtaacatgtcccactcttggattagcaggggtgggtccaggaagatgatatttgcgtcttttgcccacccccctggcattcagctggacccaactaggccatcatgagtggcttctccctgtcatccccaggggtcataggatatctacaccgcctttctgaccccaccctgcactcccatcctttcctctctccccgttcatgccctgcactacatagcacagccgggatgcttggaacagaggccttggctgctccgcagtgcacagggcttccctctctcggggttggcttcttcccaggccttgcatgggccctgcccacaagcacaccctcaggccgagggtgcagactgatgctcttccctgatggagaccctgagatcttccccacccccaatcatgatgtcttcagtgtgggactggggtcctcttggttctgcctgcagcctgcctggctccgcccctagtgccccctcctcaccacactggccccaggtctcaggaggggtgtcctgggcagggaaggtcagtgtcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcagggaaccctgcccaaggtcctcctgttcagacattcctatgttgaataaagtatgtttgacttccccggaaaaaaaaaaaaaaaa

SEQ ID NO: 201 - DNA, 2568 bp, Homo sapiens
cgccacccgcttcctcgccgcagggggcccgcccgctggcccgtttccggtccggtgggtacaagatgacggagccgggcgcctctcccgaggacccttgggtcaaggcaagccccgtgggcgcgcacgccggcgaggggagggcgggtcgggctcgtgcacgtaggggggccggaagacgaggggcttccctcctgtccccaaagtcccccacgctctccgtgccccggggctgcagagaagacagctctcaccccgcgtgtgccaaggtggagtatgcctacagcgacaacagcctggaccccgggctttttgtagaaagcacccgcaaggggagtgtagtgtccagagctaatagcatcggttccaccagtgcctcttctgtccccaacacagatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttcctttagcattgttccaagtctaaatgttaacctcaagctactgcaatttagacaatgaaatgggctgggtctacccccagccaccagccctcatcctctctacccagtgctctggtttatgcttgtctcctgactgctctgcttaaaggtgaaagtagcaggaacaacaacaaaagccaaccaaaaacaaggtagccagtgcaagacatctcactcttctgacatcctgcagtccccaccagtcctgaccgtgggcccctcaggggtctgggagtgtgacgttgtaatcttcatccgtctctatcccaacttcctcctgtgagacagggagacaagtgaatgagatgtcaccaggataagaccacagggaagcaaagaaggaagagagctccacttacaaagaactgcttcttgctcttggggtatccttcaagtattgcatcagacagctctgtagcctgacaagaaataaaaccacccgttttcagatgggcaaaaaaa

SEQ ID NO: 202 - DNA, 2406 bp, Homo sapiens
cgccacccgcttcctcgccgcagggggcccgcccgctggcccgtttccggtccggtgggtacaagatgacggagccgggcgcctctcccgaggacccttgggtcaaggtggagtatgcctacagcgacaacagcctggaccccgggctttttgtagaaagcacccgcaaggggagtgtagtgtccagagctaatagcatcggttccaccagtgcctcttctgtccccaacacagatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttcctttagcattgttccaagtctaaatgttaacctcaagctactgcaatttagacaatgaaatgggctgggtctacccccagccaccagccctcatcctctctacccagtgctctggtttatgcttgtctcctgactgctctgcttaaaggtgaaagtagcaggaacaacaacaaaagccaaccaaaaacaaggtagccagtgcaagacatctcactcttctgacatcctgcagtccccaccagtcctgaccgtgggcccctcaggggtctgggagtgtgacgttgtaatcttcatccgtctctatcccaacttcctcctgtgagacagggagacaagtgaatgagatgtcaccaggataagaccacagggaagcaaagaaggaagagagctccacttacaaagaactgcttcttgctcttggggtatccttcaagtattgcatcagacagctctgtagcctgacaagaaataaaaccacccgttttcagatgggcaaaaaaa

SEQ ID NO: 203 - DNA, 2316 bp, Homo sapiens
cgccacccgcttcctcgccgcagggggcccgcccgctggcccgtttccggtccggtgggtacaagatgacggagccgggcgcctctcccgaggacccttgggtcaaggtggagtatgcctacagcgacaacagcctggaccccgatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttcctttagcattgttccaagtctaaatgttaacctcaagctactgcaatttagacaatgaaatgggctgggtctacccccagccaccagccctcatcctctctacccagtgctctggtttatgcttgtctcctgactgctctgcttaaaggtgaaagtagcaggaacaacaacaaaagccaaccaaaaacaaggtagccagtgcaagacatctcactcttctgacatcctgcagtccccaccagtcctgaccgtgggcccctcaggggtctgggagtgtgacgttgtaatcttcatccgtctctatcccaacttcctcctgtgagacagggagacaagtgaatgagatgtcaccaggataagaccacagggaagcaaagaaggaagagagctccacttacaaagaactgcttcttgctcttggggtatccttcaagtattgcatcagacagctctgtagcctgacaagaaataaaaccacccgttttcagatgggcaaaaaaa

SEQ ID NO: 204 - DNA, 1418 bp, Homo sapiens
cacgaggggagtccgggaggggtcgctttgctcctccggaaggcttccccttcagccaatcaccgttcgaggcccgcccccgtcgccggaaggagccgtcgccccgagcaactacaacgtccggctttctgagttgggtggcgggaaaggcgatgagtaaaggccgggcagaagctgcggcgggagccgccgggatcctcctgaggtacctgcaggagcagaaccggccctacagctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcaggaccagtttgacatggtgagtgatgctgaccttcaagtcctagatggcaaaatcgtggccctcactgctaaggtgcagagcttgcagcagagctgccgctacatggaggctgagatgcagaaagaaatccaggagttaaagaaggaatgcgctggctacagagagagattgaagaacattaaagcagctaccaatcatgtgactccagaagagaaagagcaggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcccacggtcaggactggtggggactgcaggatgtcagaagagtgagatgtcttgcactggctaccttgtttttggttggcttttgttgttgttcctgctactttcacctttaagcagagcagtcaggagacaagcataaaccagagcactgggtagagaggatgagggctggtggctgggggtagacccagcccatttcattgtctaaattgcagtagcttgaggttaacatttagacttggaacaatgctaaaggaaagcatttggcaatatttattataatttaattttatataaaaatatttaatttcctctggatagtcaaacctgccagatatcaaacctgaggaaggcagaagtgaatttggagaactagggtagagagaggttgctataaaacgagcatttggagggcccacggcttcactcaggacctgctgggcttgtgtaccccaggagcccttttaagtatcttttgtacgcttttcaccccacccccaagtcctgggagaaatgcaggcaacactgagacatgggagaggccaagatatgcttgacagaaagggtgattttgaggctcagttaatatttcaaaattgtaaccgtagcaaaactgcattggtatttagaaaaaaaaaaaaaaa

SEQ ID NO: 205 - DNA, 1349 bp, Homo sapiens
aactacaacgtccggctttctgagttgggtggcgggaaaggcgatgagtaaaggccgggcagaagctgcggcgggagccgccgggatcctcctgaggtacctgcaggaacagaaccggccctacagctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcaggaccagtttgacatggtgagtgatgctgaccttcaagtcctagatggcaaaatcgtggccctcactgctaaggtgcagagcttgcagcagagctgccgctacatggaggctgagctcaaggaattatctagtgccctgaccacaccagagatgcagaaagaaatccaggagttaaagaaggaatgcgctggctacagagagagattgaagaacattaaagcagctaccaatcatgtgactccagaagagaaagagcaggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcccacggtcaggactggtggggactgcaggatgtcagaagagtgagatgtcttgcactggctaccttgtttttggttggcttttgttgttgttcctcttacttttcactttagcagagcagtcaggagacaagcataaaccagagcactgggtagagaggatgagggctggtggctgggggtagaccccacgcatttcattgtctaaattgcagtagcttgaggttaacatttagacttggaacaatgctaaaggaaagcatttggcaatatttattataatttaattttatataaaaatatttaatttcctctggatagtcaaacctgccagatatcaaacctgaggaaggcagaagtgaatttggagaactagggtagagagaggttgctataaaacgagcatttggagggcccacggcttcactcaggacctgctgggcttgtgtaccccaggagcccttttaagtatcttttgtacgcttttcaccccacccccaagtcctgggagaaatgcaggcaacactgagacatgggagaggccaagatatgcttgacagaaagggtgattttgaggctcagttaatatttcaaaattgtaaccgtagcaaaactgcattggtatttagaaaaataaaaaatttccaat

SEQ ID NO: 206 - DNA, 3779 bp, Homo sapiens
agttgctgttattgtgacttgtcgggccacggccccggatgttgtggctgccgcggggagatggctgaggccgaaggggttcccacgaccccaggcccggcttcggggtcgactttcaggggccgccgagatgtgtcaggctcctgggagcgggaccagcaggttgaggcggcgcagcgggccctggtggaggtgctggggccttacgagcctctgctgagtcgggtgcaggcagccctggtgtgggagcggccagctaggagcgctctgtggtgcctggggctgaacgcggctttctggttttttgccctgacatctcttcgtcttgtgtttttacttgcatttggcttgatgatcattgtgtgtattgatcaatggaagaacaaaatctggcctgaaataaaagtgccaagacccgacgcattagacaatgagagctggggctttgtgcaccctcggttgctcagcgtgcccgagctctgccaccatgtagctgaagtctgggttagtgggaccattttcataaggaatgttttgcttttcaaaaagcaaaacccaggcaagttctgcttgctgagctgtgggatactgacctttttggctgtcttgggccgctacgtccctgggcttctgctgtcctacttgatgcttgtcactgtcatgatgtggccccttgctgtgtaccaccgactgtgggatcgagcatatgtgcggctgaagccagctctgcagcggctagacttcagtgtccgtggctacatgatgtccaagcagagagagagacaattacgccgcagagctctccacccagaacgagccatggacaaccacagtgacagcgaagaggagcttgctgccttctgtcctcagctggacgattctactgttgccagggaattggccatcacagactctgagcactcagacgctgaagtctcctgtacagacaatggcacattcaatctttcaaggggccaaacacctctaacggaaggctctgaagacctagatggtcacagtgatccagaggaatcctttgccagagaccttccagacttcccttccattaatatggatcctgctggcctggatgatgaggacgacactagcattggcatgcccagcttgatgtaccgttctccgccaggggctgaggagccccaggccccacctgccagccgggacgaggctgcgctgccggagctcctgcttggtgctcttcctgtaggatccaacctcaccagcaaccttgccagcctggtctcccagggtatgattcagctggccttgtcaggggcctcccaaccaggcccttctggagcacctgcccagagagcaacgagaggcttcctccggtcccccagttcagacctggacactgatgctgagggggatgactttgaacttctggaccagtcggagctgagtcagctggaccctgccagttctaggagccactgaggcagagactcctttttggagtcactgtggtttaggtttttttctccccatcccacttaaggtgatggggcaagggaagaactcagctcccctcccctgaattatatttgtatgctgggtggcctggctgatgctcagaggcctccttagagaggacactcactcccctcccaccagctggatgcccatttctgagctcagtcactgaagtgagagtgtgctcccccaagggaggcttctctccatcaggatggtactttgggggaacaaaatagtcagggatattggttcccctttgaggaggtgctgctgtttgcttttaggtatgagtgctcaggggccctcactgaaagagcccatgcctgccttcctcctttcatcgcctctctagagcccccaaagtcaggcagcagctggagtagttacattgtcatcatctttttttttgagacagtttcgctctgttgcccaggctggagtgcagtggtgtgatcttggctttctgcaacgtctgccttccaggttgaagaggttctcctgcctcagcctccttagtagtgggattacaggtgcccgctactatgcccggctaatttttcttttggtatttttagtagaaatggggtttcaccatgttggccaggctggtctcaaactcctgacctcaagtgagctgactgccttggcctcccagagtgctgggattagtcgtcatcttttgttaaaccaggatttgatttttttcttttcttttcttttcttttctttttttttttttttgagacagagtctctctctgttgcccaggctggagtgcagtggcacaatctcggctcactgcagcctccgcctgccgggtcaagcgattctcctacctcagcctcctcagtagctgagattacaggcatgcaccaccatgcccggctaatttttttgtgtttttagtagagatggggtttcaccgtgctggccaggctggtctagaactcctgactgcaaatgatcagcccgcctcagccacccaaagtgttgggattacaggtgtgagccactgtgcccagcgtgatttttttttttttttaaagcaaacttgtcctttggttttgcagaacaggcctgctccctctcatctagcccaccatttcttggggcctgaaccccagtggtccaaagtattgcttgtgaaatttaaaaaatgtgaatatgatgtggggatgggcctcttctacattaccttggcccagggggatcagctggctgggaggattagtgagcacctctgtattttgaggtctgagtcttctggagctgtgtagttaatcttcggtttctgataacccctgggtccatctggccatcagcctcagcagtgagcaaagcaataccatactcatttctatgttcctgttccttcctctgctcctcctttggagaagcaataattcatgggggatgatacagtagcactttacaaatggctccatgtcattcatcccaggggccataatctcttgcaccacctattcttacttcctgttcagctcctttacagcttttattttcaactgcttcccaacttggtggggcctcctttaaggatgagccaatagtaagaatgtggctgtaatcagcagagacccctctgaggggtatctgttctgcagcccctagtgaaatcatgtgatgtgagacagaaacctaaacatggtacttgattctaaacctgtgccagtctatagcctctgcctccccaagcagagctcaagccaaacgcttctgtcctctttccttctgcattaaccctttgctgatcctcaggggccactcccccaacacccctgtacttgggtgagggatgttggacagagcctgttttcatgtactgcaggtgggggtgtgctgacatgtttgctcttggttgatggagaaggtacagaggccagggagtgaaaatggttgacagaagagggaagagttaggtgtctcatagtcactcatagtggggtggtcaggggtaatggcatctccccactttaggcttctcaaacagacttttgacacctctcaagttcagagctctgatgtggaaagacaggaggtgtggggaaggagggggatttcgtgtgtttgcatgagtgtgcgcttcaggccttgggagttggcaagagggagggaaggaaggagagcaaaatcttcggaatgtgtttcttgtacctgagggatcctgccctgaatctccatagtctccactgtgaactgaggaggggaggggtgtgctggggaataaatcttgtatgagaacaaaaaaaaaaaaaaaa

SEQ ID NO: 207 - DNA, 4640 bp, Homo sapiens
cccgcggctcgggatggaggctggacacctgttctgctgttgtgtcctgccattctcctgaagaacagaggcacactgtaaaacccaacacttccccttgcattctataagattacagcaagatggaaataccaaatccccctacctccaaatgtatcacttactggaaaagaaaagtgaaatctgaatacatgcgacttcgacaacttaaacggcttcaggcaaatatgggtgcaaaggctttgtatgtggcaaattttgcaaaggttcaagaaaaaacccagatcctcaatgaagaatggaagaagcttcgtgtccaacctgttcagtcaatgaagcctgtgagtggacacccttttctcaaaaagtgtaccatagagagcattttcccgggatttgcaagccaacatatgttaatgaggtcactgaacacagttgcattggttcccatcatgtattcctggtcccctctccaacagaactttatggtagaagatgagacggttttgtgcaatattccctacatgggagatgaagtgaaagaagaagatgagacttttattgaggagctgatcaataactatgatgggaaagtccatggtgaagaagagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggcaacaaaaagagttccaagaaacagttcccaaatgacatgatcttcagtgcaattgcctcaatgttccctgagaatggtgtcccagatgacatgaaggagaggtatcgagaactaacagagatgtcagaccccaatgcacttccccctcagtgcacacccaacatcgatggccccaatgccaagtctgtgcagcgggagcaatctctgcactccttccacacacttttttgccggcgctgctttaaatacgactgcttccttcacccttttcatgccacccctaatgtatataaacgcaagaataaagaaatcaagattgaaccagaaccatgtggcacagactgcttccttttgctggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtctttcagtttgcagtcaaagaatcacttatcctgaagctgccaacagatgagctcatgaacccctcacagaagaagaaaagaaagcacagattgtgggctgcacactgcaggaagattcagctgaagaaagataactcttccacacaagtgtacaactaccaaccctgcgaccacccagaccgcccctgtgacagcacctgcccctgcatcatgactcagaatttctgtgagaagttctgccagtgcaacccagactgtcagaatcgtttccctggctgtcgctgtaagacccagtgcaataccaagcaatgtccttgctatctggcagtgcgagaatgtgaccctgacctgtgtctcacctgtggggcctcagagcactgggactgcaaggtggtttcctgtaaaaactgcagcatccagcgtggacttaagaagcacctgctgctggccccctctgatgtggccggatggggcaccttcataaaggagtctgtgcagaagaacgaattcatttctgaatactgtggtgagctcatctctcaggatgaggctgatcgacgcggaaaggtctatgacaaatacatgtccagcttcctcttcaacctcaataatgattttgtagtggatgctactcggaaaggaaacaaaattcgatttgcaaatcattcagtgaatcccaactgttatgccaaagtggtcatggtgaatggagaccatcggattgggatctttgccaagagggcaattcaagctggcgaagagctcttctttgattacaggtacagccaagctgatgctctcaagtacgtggggatcgagagggagaccgacgtcctttagccctcccaggccccaacggcagcacttatggtagcggcactgtcttggctttcgtgctcacaccactgctgctcgagtctcctgcactgtgtctcccacactgagaaaccccccaacccactccctctgtagtgaggcctctgccatgtccagagggcacaaaactgtctcaatgagaggggagacagaggcagctagggcttggtctcccaggacagagagttacagaaatgggagactgtttctctggcctcagaagaagcgagcacaggctggggtggatgacttatgcgtgatttcgtgtcggctccccaggctgtggcctcaggaatcaacttaggcagttcccaacaagcgctagcctgtaattgtagctttccacatcaagagtccttatgttattgggatgcaggcaaacctctgtggtcctaagacctggagaggacaggctaagtgaagtgtggtccctggagcctacaagtggtctgggttagaggcgagcctggcaggcagcacagactgaactcagaggtagacaggtcaccttactacctcctccctcgtggcagggctcaaactgaaagagtgtgggttctaagtacaggcattcaaggctgggggaaggaaagctacgccatccttccttagccagagagggagaaccagccagatgatagtagttaaactgctaagcttgggcccaggaggctttgagaaagccttctctgtgtactctggagatagatggagaagtgttttcagattcctgggaacagacaccagtgctccagctcctccaaagttctggcttagcagctgcaggcaagcattatgctgctattgaagaagcattaggggtatgcctggcaggtgtgagcatcctggctcgctggatttgtgggtgttttcaggccttccattccccatagaggcaaggcccaatggccagtgttgcttatcgcttcagggtaggtgggcacaggcttggactagagaggagaaagattggtgtaatctgctttcctgtctgtagtgcctgctgtttggaaagggtgagttagaatatgttccaaggttggtgaggggctaaattgcacgcgtttaggctggcaccccgtgtgcagggcacactggcagagggtatctgaagtgggagaagaagcaggtagaccacctgtcccaggctgtggtgccaccctctctggcattcatgcagagcaaagcactttaaccatttcttttaaaaggtctatagattggggtagagtttggcctaaggtctctagggtccctgcctaaatcccactcctgagggagggggaagaagagagggtgggagattctcctccagtcctgtctcatctcctgggagaggcagacgagtgagtttcacacagaagaatttcatgtgaatggggccagcaagagctgccctgtgtccatggtgggtgtgccgggctggctgggaacaaggagcagtatgttgagtagaaagggtgtgggcgggtatagattggcctgggagtgttacagtagggagcaggcttctcccttctttctgggactcagagccccgcttcttcccactccacttgttgtcccatgaaggaagaagtggggttcctcctgacccagctgcctcttacggtttggtatgggacatgcacacacactcacatgctctcactcaccacactggagggcacacatgtaccccgcacccagcaactcctgacagaaagctcctcccacccaaatgggccaggccccagcatgatcctgaaatctgcatccgccgtggtttgtattcattgtgcatatcagggataccctcaagctggactgtgggttccaaattactcatagaggagaaaaccagagaaagatgaagaggaggagttaggtctatttgaaatgccaggggctcgctgtgaggaataggtgaaaaaaaaacttttcaccagcctttgagagactagactgaccccacccttccttcagtgagcagaatcactgtggtcagtctcctgtcccagcttcagttcatgaatactcctgttcctccagtttcccatcctttgtccctgctgtcccccacttttaaagatgggtctcaacccctccccaccacgtcatgatggatggggcaaggtggtggggactaggggagcctggtatacatgcggcttcattgccaataaatttcatgcactttaaagtcctgtggcttgtgacctcttaataaagtgttagaatccaaaaaaaaaaaaaaaa

SEQ ID NO: 208 - DNA, 4640 bp, Homo sapiens; identical to SEQ ID NO: 207

SEQ ID NO: 209 - DNA, 793 bp, Homo sapiens
gggaaggaggagtggcaacatggcgtcttcgggagctggtgaccctctggattctaagcgtggagaggccccgttcgctcagcgtatcgacccgactcgggagaagctgacacccgagcaactgcattccatgcggcaggcggagcttgcccagtggcagaaggtcctaccacggcggcgaacccggaacatcgtgaccggcctaggcatcggggccctggtgttggctatttatggttacaccttctactcgatttcccaggagcgtttcctagatgagctagaagacgaggccaaagctgcccgagcccgagctctggcaagggcgtcagggtcctaatctggatgggtattgatcatgtccaacctgctggagccccttcacatggtggatgatgccccatgaccctgtagaaattgaatcctgctcacaacattgttggccttcttactaaccttggaccgtgattgagcccaagaaaccagggacttacgcatttggccaatgtcaaaagaacagaactttgcccactgcacacttgctgtgtacaatgactgagccctttcttgtagtttgtttccttgtttgagaggtgtgcatgcgaccgtggcttttcccaaagtttctgactttgtggtttacccccttcaccttccagggacgcagttgttacgaggttagacgtggcagctctgtgcagtgtttgagcctacagtgggatacatagggtcaaattgagaataataaactgagtcattctcctggaaaaaaaaaaaaaaaaaaaaaaaaaaa

SEQ ID NO: 210 - DNA, 2144 bp, Homo sapiens
gctgaagacagagcgatggtagttctggaggcctcgctccggggccgacccgaggccacagtgcctccgcggtagaccggacttgggtgacgggctccgggctcccgaggtgaagagcatcgggggctgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaaactgaaaaaaaaaaaaaaaaaaaaaaaaaaaaaaaa

SEQ ID NO: 211 - DNA, 3189 bp, Homo sapiens
ggcgtgagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgcagaccctggtgcaatgctctggtggctagggatgtactcatgctcatatgtgtgcacgcttggacacccacctccatggacacctagccaccctgttgtgtgtccttatgccagttgagctgaatcttttccccagtatagtggaaagactgaggcttctgcctactgagcaaggttgggtgcttcatttgtgttcagtctgaattatgggaaagttagctcttcccagacctaagctgccttctctccctactttcagaagatcctagttccttccttcccgagtgatacccatgaactgccagtagaggctgctatcgttccatgtgtaaggaatgaactggttcaaggcgcgtcctacccagtcattttctttaccttatactaattcttcctgaataatgtcttcagtttcttgaggagactcctagttttggttttcaaattacttggagggctgcctaggaatctatctccctctgaaataaagtttcctcatcttccaccttgcaaaaaaaaaaaaaaaaaa

SEQ ID NO: 212 - DNA, 3228 bp, Homo sapiens
ggcgtgagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacgccttcaggcaaaggtcctcatatatgttttgacctccaggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgcagaccctggtgcaatgctctggtggctagggatgtactcatgctcatatgtgtgcacgcttggacacccacctccatggacacctagccaccctgttgtgtgtccttatgccagttgagctgaatcttttccccagtatagtggaaagactgaggcttctgcctactgagcaaggttgggtgcttcatttgtgttcagtctgaattatgggaaagttagctcttcccagacctaagctgccttctctccctactttcagaagatcctagttccttccttcccgagtgatacccatgaactgccagtagaggctgctatcgttccatgtgtaaggaatgaactggttcaaggcgcgtcctacccagtcattttctttaccttatactaattcttcctgaataatgtcttcagtttcttgaggagactcctagttttggttttcaaattacttggagggctgcctaggaatctatctccctctgaaataaagtttcctcatcttccaccttgcaaaaaaaaaaaaaaaaaa

SEQ ID NO: 213 - DNA, 2661 bp, Homo sapiens
tgttagaatctgatttcacctctcagcatccaccatgcatctcaagatagtcctggcgttcctggcactgtccctcattaccatctttgccctggcctatgttttgctgaccagcccaggtggttccagccagcctccccactgcccctctgtatcccatagggcccagccctggccacaccctggccagagccagctgtttgcagacctgagccgagaggagttgacagctgtgatgcgctttctgacccagcggctggggccagggctggtggacgcagcccaggctcagccctcggacaactgcatcttctcagtggagctgcagctgccccccaaggctgcagccctggcccacctggacagggggagccccccacctgcccgggaggcactggccatcgtcctctttggtggacaaccccaacccaatgtgagtgagctggtggtggggccgctgcctcacccctcgtacatgcgggatgtgactgtggagcgtcacggcgggcccctgccctatcaccgtcgcccggtgctgagagctgagtttacacagatgtggaggcatctgaaagatgtggagctacccaaggcacccatcttcctgtcgtccaccttcaactacaatggctctaccctggcagctgtgcatgccacccctcggggcttgcgctcaagggaacgaactacctggatggccctctaccataacatctcaggggttggtcttttccttcaccccgtggggctggagctactactggaccacagggccctggaccctgcccactggactgtccagcaggtcttctaccttgggcactactatgcagacttgggccagttggaacgggagtttaagtctggccggttggaagtggttagagtccctctacctccaccaaatggagcttcatccctgaggtctcggaactctccaggtcctcttccccctcttcagttctcgccccagggttcccagtacagtgtgcaaggaaacctggtggtatcctccctctggtcatttacctttggccatggggtgttcagcggcctgaggatttttgatgttcggttccagggtgagcgaatagcctatgaagtcagtgtccaggagtgtgtatctatctatggtgccgattcacccaagacgatgctgactcgctatttggatagcagctttggactcggccgtaacagccgaggcttggtgcggggagtggactgcccctatcaagccacgatggtggacatccatatattagtgggcaaaggggcagtccagctgcttccaggggctgtgtgtgtatttgaggaagcccagggactgccccttcgaaggcaccacaattaccttcaaaatcatttctatggtggtttggccagctcagcccttgtggtcaggtctgtgtcatctgtgggcaactatgactacatttgggactttgtgttgtacccaaatggggcacttgaagggcgggtccatgccacgggttatatcaacacagctttcctgaaagggggagaggagggcctcctctttgggaaccgtgtgggggaaagagtgctgggaacggtgcacacacatgccttccacttcaagctggacctggatgtggcagggctgaaaaactgggtggtagctgaagacgtggtgtttaaacctgtggctgccccctggaacccggagcactggctacagcgcccacagctgactcggcaggtcctgggaaaggaggacctgacagctttttccttgggaagccccctaccccgctacctctacctggctagcaaccagactaatgcgtggggtcaccagcgcgggtaccgaatccagatccacagcccccttggcatacaaatacccctggagagtgacatggagagggccctcagctgggggagataccagcttgtggtgacccagagaaaggaggaggagtcacagagcagtagcatctatcaccagaatgacatctggacacccacagttacctttgctgacttcatcaacaatgaaaccctcttaggagaggatctggtggcttgggtcacagccagcttcctgcacattccccatgccgaggacatcccaaacacagtgactctggggaacagagttggcttcttgctccgaccctataacttctttgatgaggacccctccatcttctcccctggcagtgtgtactttgagaagggccaggatgctgggctctgcagcatcaatcctgtggcctgcctccccgacctggcagcctgtgtcccggacttaccccctttctcttaccacggcttctagtcctgagggtgtggcgggcggcgtggttaggcacatgtacttttccctgtttctactttctattctccgtgtttttatcacacctgctccccagattcccaccccctcaatgttcctctcacacgaaacccccatcagtccctttggttaattcttacttcctgttcatctctaaagtgttaaattataaaaatgatttttaaatattcaaagaaaaatatcacaaatcctactactcagaaataggtggtcacattacatcagacatctctttatgcatgtgcattcaaaaggaagagtagatagaattttgtaaaacagatgttgtatgtaatttataataaaaagtattaaag

SEQ ID NO: 214 - DNA, 2661 bp, Homo sapiens; identical to SEQ ID NO: 213

SEQ ID NO: 215 - DNA, 1835 bp, Homo sapiens
tggagattccctgctccaagtcttctgggcgctccaggttctgtgaggccccacgggagccccggacccctggtctctgtaactgtggggtgagggaaggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatttcaccaccaccgtggtctcttgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaaaaaaaaaaaaaaaaaaaaaaaaaaaaaaaaaaaaaaaaaaaaaaa

SEQ ID NO: 216 - DNA, 513 bp, Homo sapiens
tccttctttcctttttgctgtaggcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaaaaaaaaaaaaaaaaaaaaaaaaa

SEQ ID NO: 217 - DNA, 4116 bp, Homo sapiens
cgccgctctccgcctcgcttgctcctgccgggcgtgcagggccccgccgccgccatgtcgggctcgttcgagctctcggtgcaggatctcaacgacctgctctcggacggcagcggctgctacagcctcccgagccagccctgcaacgaggtcaccccgcggatctacgtgggcaacgcgtctgtggctcaggacatccccaagctgcagaaactaggcatcacccatgtgctgaacgcggctgagggcaggtccttcatgcacgtcaacaccaatgccaacttctacaaggactccggcatcacatacctgggcatcaaggccaacgacacacaggagttcaacctcagcgcttactttgaaagggctgccgacttcattgaccaggctttggctcaaaagaatggccgggtgctcgtccactgccgggaaggttatagccgctccccaacgctagttatcgcctacctcatgatgcggcagaagatggacgtcaagtctgccctgagcatcgtgaggcagaaccgtgagatcggccccaacgatggcttcctggcccagctctgccagctcaatgacagactagccaaggaggggaagttgaaaccctagggcacccccaccgcctctgctcgagaggtccgtgggggaggccgtgggcaaaggtgtcccgagctgccatgtttaggaaacacactgtaccctgctcccagcatcacaaggcacttgtctacaagtgtgtcccaacacagtcctgggccactttccccaccctggggagcacataaagaagcttgccaaggggggcgtccttgctccccagttgtcctgtttctgtaacttatgatgtcttttccctgagatgggggctcagagggggaaggcctgtggcctgcatgcttcccgatggcccacggcaggaggtgtgtggaagtgtaaggcctaagatgctcacagaggtccctcatgacctcccttccccaactcccgaatcctctcttgagtgtggacctcaacaccttgagccctagtaaaggaactatgcaaatgcaggccactctccccaccacgtctgtgccccgcactgtccccacagccttccacaccctgtgcataggcagccctctcacgtcttgaggtccgaagctggggtgggggtgtccgtcagttattagtggatggagattcccacagcaaggctgcatttgaatgatttccttaggatgaatggtccctacacaaagaggccttgtgggcaaacctggagaaccctcctaaatccatagagttttcaaaatgtgaatctttggaagccttgagttcagaatctgctgctctggaatatttcccttcgatcttatctcagtcacttcgtttttgagaagagtgatgccttgggcatgcttttttttttttcttttttagaaaacagggagttgaagtccaacctatttaaaaaccccaccatttggagaattacaagggttttgtcctgaattgtagtgttggcaagcccaagccactcgtgctaactgctttttgtctcggttgctattccaagaacagaaggaggaagttggccaattacagcgtgtgtgcatggatgtgtgtggggggcgtgcctctcagaaacgcggccagaagacaagcagggaagtgaaaggtcccaggcacacaccctgcccattgcaggtggctcttacagctctctggtgccagcacgggatccctgaagtgactcagccaggcagacatgagacatggcggagtgtccaaatggatcctttattggtggtagagcaaaaaaacccaaacacgataaacctttcaaaagactttctaaggatgatattggaatgcaccagccctcacatgtgtatgcacatttgccagaatataagagttttgttttaaatacagtcttgttaggattttacgttattgttattatggaaagtgattgtgatgctatttatcttcagggtcactctgggcaaagagaaggtcctcagccatgcccccagcaccttgcacataggtgtctgataaaagtttaagaaattaaacactttttgagcaccaaatatatatagggcattgttctggtgggtgtgtcacgctcccagaagactgaatttatggtaggatcactcgcaaggccttgtgaaggagtcttacctaaaacaaaagaaatatcagggacttttgttgactatttacaactcagttttacatttaaattcaggcagtgttaatatgccaaggtagggaatgtgcctttttcagagttggccaggagctcctggctgggacacggagaggcaggtgtggcgtaaggcctcactcccggctgtgaaggtctctgatcacacagaagcagccctgcccagcctggtcatttgctgtccgcttttctctgtgaccacagcagccctgaacaaccagtatgtgtcttcttctccagatagtgaaaaaggtgtccagataaacccacctaagtgaaatggccatcctctaaactgggtacctcactgcacagcttctaggtagccttccaacttaatctaacttgagcctcacagtaaccctgtaaagttagtagagcttgttcttgtattgtgaccttttttaaaaaaaaggaactgaggttcagaatgattaagggcctggcccccagggttgtccagctccataaggtggagctgggcaagattttgggtttgctgctccctgaagctggattctttcatacgatactctttctcaagaagggggctccctgggatctccaggtgtactgcacttaccctcaatccagccccggagaagcaagtgaaaagggtgggtccctcataggctagaatgtgcagctctttctccaggtgggatgtagcaccccaaagtagagctttctgctctgctcctggaaaaggctagggagctggggctggggctcccctcccatgaccaggcagtggtcaccccatgggacaggcacagctacttacgcgaacacagcaggttggtgtggctggctaactaggacctctcgaaagtctctgtgggggcatgagggagaaaaggccattgggagaattactgcctttactttgggactacttttatgctgataacttgggatttcttgatagtccttcacccctgaaaccccgtatttacttaacaagatttagctcttagttcttcaagtaaaattaaagtctcttgtgtaagagccaacacatgcccagctgcggatgggagctgttcctggacagccttctactgcctgggaagtgatggaacaggaactcagggtgcccttaccccctccccagacctgttccctttctttgactgacagagcaccatccaggcaaaattagagcgccaaatggttttcttctcaatcttaaagcagtatacctttccacaggctcgtctgtgtccctgccactctgagttatccagaaaccaccacctacaaatgaggggactcatctagaagacctctaaggtccccttttggctctgaggggtctctaataatccccacttggaattcagcaccgcaaggaaattatgggtatgtgagccataatatgatggccagcaggtggcgctgccttccacccatggtgatggatggtttggaaagggaatgttggtgccttttgtgccacaagttaagatgctactgttttaaaggaaaaaaaaaaaaaaaagtactgatcttcaatatgaagacatgagcttttctcgcaggaaattttctttttcacagaactggtgtcaggaatcactgaagggctaaccgtgatagtccttgcaagtaagtcaaggttttatcctgattggaaatagaagacatttccggttgagagaacagattcgttggaagcttaacttttgttgcctcttaacgccaccaaattttagggtaatttgattatgaaagagtgaatttttctggacagaaaagggagagctaccaaattgtttttttctttttaaaaggaagtttaatgtccgttgtatcacaaatcagtgttaaaacaccagaactttagccaaaataaatgtcttacattacaaaggtaaaaaaaaaaaaaaaaa

SEQ ID NO: 218 - DNA, 3012 bp, Homo sapiens
agcttccacgccgctgtttcttcatcaataaaatgggaacattcgcagtcatttctcaggactttgtgcagacaaaaagtttatcatagaaatcaccccacacaatgcttggcacatcgaggacactcagcacatcttagctttatttccttcctctctgaaaaaagtaagcagagttatttgttcccatcctctctgtccacagcctggtctcagagaacacagtagatgtgtagtcagtttgttcaataaatatgcttgatggagcttcaatacccacctccacccccttcttccagaatctgcagggagaggtcgggaggtgacaacgccagcatgccagtgctatcggaggactctggtttgcatgaaaccctggccctgctgacctcccagctcagacctgactccaaccacaaggaggagatgggcttcctgagggatgttttcagtgaaaaaagcctcagttacttaatgaagattcatgagaagcttcgctattatgaaaggcaaagtccaaccccagttctgcacagcgctgtggccctcgctgaggacgtgatggaggagttgcaggccgcctccgtgcacagtgatgagagggagctgctccagctgctgtccaccccgcacctgagggctgtgctcatggtacatgacacggttgcccagaagaattttgaccccgttctcccgcctctgcctgacaatatcgatgaggattttgatgaggaatcggtgaagatcgtccgcttggtgaagaacaaggaacccctgggtgccaccatccggcgggacgagcactcaggggctgttgtggtggccaggatcatgcgaggaggcgcagcagacaggagcggcctggtccacgttggagatgagctccgagaagtgaacgggatcgcagtcctgcacaagcggcccgacgagatcagccagattctggcccagtcccagggatccatcaccctaaaaatcatcccagccacccaggaggaagatcgcttaaaggagagcaaggtgttcatgcgcgccctcttccactacaaccctcgggaggaccgggccatcccttgccaggaggcgggcctgcccttccagcgcaggcaggtcctggaggtggtgagccaggacgaccccacgtggtggcaggccaagcgagtcggggacaccaaccttcgagccggcctcatcccctccaaggggttccaggagagacgactaagctaccggagagccgcgggcaccctgccgagcccccagagcctcaggaagcccccctatgatcagccttgtgacaaagagacctgtgactgtgagggctacctcaaagggcactatgtggctggtcttcggaggagcttccggctgggctgtagggagagactgggtggctcgcaggaaggaaagatgtcctccggagctgagtctccggagctgctgacttacgaagaggtggccaggtaccaacaccagcccggagagcggccccgcctggtggttctgatcgggtctctgggagcccgactgcacgagctgaagcaaaaggtggtggctgagaacccacagcactttggcgtcgctgttccacataccaccaggccccgaaagagccatgagaaggaaggagtggaatatcactttgtgtctaagcaagcatttgaggccgacttacatcacaacaagttcctggaacatggtgaatataaggaaaatctgtatggaaccagcctggaggccattcaggctgttatggccaaaaacaaagtttgtttggtggatgtggagccagaagcactgaaacaactgaggacctcagaatttaaaccctatattatatttgtaaagcctgcaattcaggaaaaaagaaaaacgccacctatgtccccagcttgtgaggacacagcagccccatttgatgagcagcagcaagagatggccgcttctgccgccttcatagaccggcattacgggcacctggtagacgccgtgctggtgaaggaggatctccagggtgcctacagccagctcaaagtggtcttagagaagctgagcaaggacactcactgggtacctgttagttgggtcaggtaactttatcccagaacatccaagctggacgggaccttgaagatcatctagtccagactccctcattttaccatcaaggaatctcaagcgcagagagggagagaattctccacaaattccatcatcgagaagagtataagtgggaagtcttgtttgttgttggtttttgtctgttgtttttcactgcacctctttggatcatgatttgaaaggggcatatcagaaaacaacacatttcatttattaaagtatcacaggcaagctgaccctgattctttgtaccaaagttaagtagccactgtcttttgtgggtggtagtggttaatttatacagtactgattcgcagaatgtttaagctttttaaacatagtgacgcttagtagtttttttggaagctaacttgttttatccaaggggattttacatgtaactgaagttcccctgtcttcaagcactaaaacgttgatcttaaccttttttttgaagtgcttgcctggtaatagaaaacgggttctctgcctattttaaaatagtgaatatacgtaaattttctctggaaggctgaggcacacttcaccatcaacatgaattactgtactatcctgtactgcagtggtgccttcagggactcgaggaatgtaaggttgcctttcccctttctaaataccctcagattcctaacatcgagcccatgctttgtttgatttgttctattccatccattgtcccttttgttactgacagttgccttggtcctagccagtccctgccatgagatcataggggttcccattgtgctagatcttgggaaaccagatgactctccctgtcaaaactatggctacgtcactgtaaaccatttctgtcaagaataaaagtatgtagacccagagtgtgggcctaaaaaaaaaaaaaaaaaa

SEQ ID NO: 219 - DNA, 4219 bp, Homo sapiens
cccggctgcgctggagccgcccggagctaggggcttcccggggcgcaggagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggagatcctgcgggacctggcgcagctggctgagcagagcagcacagccgccgagctggcccacatcctccaggagccccacttccagtccctcctggagacgcacgactctgtggcctcaaagacctatgagacaccaccccccagccctggcctggaccctacgttcagcaaccagcctgtacctcccgatgctgtgcgcatggtgggcatccgcaagacagccggagaacatctgggtgtaacgttccgcgtggagggcggcgagctggtgatcgcgcgcattctgcatgggggcatggtggctcagcaaggcctgctgcatgtgggtgacatcatcaaggaggtgaacgggcagccagtgggcagtgacccccgcgcactgcaggagctcctgcgcaatgccagtggcagtgtcatcctcaagatcctgcccagctaccaggagccccatctgccccgccaggtatttgtgaaatgtcactttgactatgacccggcccgagacagcctcatcccctgcaaggaagcaggcctgcgcttcaacgccggggacttgctccagatcgtaaaccaggatgatgccaactggtggcaggcatgccatgtcgaagggggcagtgctgggctcattcccagccagctgctggaggagaagcggaaagcatttgtcaagagggacctggagctgacaccaaactcagggaccctatgcggcagcctttcaggaaagaaaaagaagcgaatgatgtatttgaccaccaagaatgcagagtttgaccgtcatgagctgctcatttatgaggaggtggcccgcatgcccccgttccgccggaaaaccctggtactgattggggctcagggcgtgggacggcgcagcctgaagaacaagctcatcatgtgggatccagatcgctatggcaccacggtgccctacacctcccggcggccgaaagactcagagcgggaaggtcagggttacagctttgtgtcccgtggggagatggaggctgacgtccgtgctgggcgctacctggagcatggcgaatacgagggcaacctgtatggcacacgtattgactccatccggggcgtggtcgctgctgggaaggtgtgcgtgctggatgtcaacccccaggcggtgaaggtgctacgaacggccgagtttgtcccttacgtggtgttcatcgaggccccagacttcgagaccctgcgggccatgaacagggctgcgctggagagtggaatatccaccaagcagctcacggaggcggacctgagacggacagtggaggagagcagccgcatccagcggggctacgggcactactttgacctctgcctggtcaatagcaacctggagaggaccttccgcgagctccagacagccatggagaagctacggacagagccccagtgggtgcctgtcagctgggtgtactgagcctgttcacctggtccttggctcactctgtgttgaaacccagaacctgaatccatccccctcctgacctgtgaccccctgccacaatccttagcccccatatctggctgtccttgggtaacagctcccagcaggccctaagtctggcttcagcacagaggcgtgcactgccagggaggtgggcattcatggggtaccttgtgcccaggtgctgcccactcctgatgcccattggtcaccagatatctctgagggccaagctatgcccaggaatgtgtcagagtcacctccataatggtcagtacagagaagagaaaagctgctttgggaccacatggtcagtaggcacactgcccctgccacccctccccagtcaccagttctcctctggactggccacacccaccccattcctggactcctcccacctctcacccctgtgtcggaggaacaggccttgggctgtttccgtgtgaccaggggaatgtgtggcccgctggcagccaggcaggcccgggtggtggtgccagcctggtgccatcttgaaggctggaggagtcagagtgagagccagtggccacagctgcagagcactgcagctcccagctcctttggaaagggacagggtcgcagggcagatgctgctcggtccttccctcatccacagcttctcactgccgaagtttctccagatttctccaatgtgtcctgacaggtcagccctgctccccacagggccaggctggcaggggccagtgggctcagcccaggtaggggcaggatggagggctgagccctgtgacaacctgctgttaccaactgaagagccccaagctctccatggcccacagcaggcacaggtctgagctctatgtccttgaccttggtccatttggttttctgtctagccaggtccaggtagcccacttgcatcagggctgctgggttggaggggctaaggaggagtgcagaggggaccttgggagcctgggcttgaaggacagttgccctccaggaggttcctcacacacaactccagaggcgccatttacactgtagtctgtacaacctgtggttccacgtgcatgttcggcacctgtctgtgcctctggcaccaggttgtgtgtgtgtgcgtgtgcacgtgcgtgtgtgtgtgtgtgtgtcaggtttagtttggggaggaagcaaagggttttgttttggaggtcactctttggggcccctttctgggggttccccatcagccctcatttcttataataccctgatcccagactccaaagccctggtcctttcctgatgtctcctcccttgtcttattgtccccctaccctaaatgcccccctgccataacttggggagggcagttttgtaaaataggagactccctttaagaaagaatgctgtcctagatgtacttgggcatctcatccttcattattctctgcattccttccggggggagcctgtcctcagaggggacaacctgtgacaccctgagtccaaacccttgtgcctcccagttcttccaagtgtctaactagtcttcgctgcagcgtcagccaaagctggcccctgaaccactgtgtgcccatttcctagggaaggggaaggagaataaacagaatatttattacaaatgttagaatatatttcttatactaggaatctcatttgcatttgcatagactatacacatggggtggaaaggccaggcctgcccccatctcgttggtgtggctctgcgtatactacacactcattctcctgctcctcttttcccttagtcagtgtcctttcatcctgattcagctctgccttgcatcaccctcagcctaagggagtgggaaggaaatggggtgttttcttgctgacctgaggctatagggtcacttgccatttcctaccttctctgggggatttgagggtagaggcaggggaagatctgttgttgcagttgcttctgcccccttgatccaaatgaccatcatctctgatggagatgggttgggtacctggccttcatggcaccttcactgctagggatgctcaaggggcaggcctggggcccttccctcctgtctcttctcggtctttcctctctgagcagcctcctacctcccctgcctgagccctcactccacagccctcccaggtacctagcagaggctgtcagtccttggctcacctggaacagggctggggctgggttggaacaggtgtgtgcccccaccacagctctatgactctgttctccctccctgccattgtggactcttgtatttgagggacctcaagagagtgaggaccctaccatccactgtccatattcagtcccagccccagtgcgcttcctctgttccctccctcagccatccaattcttgagttttctcactgattggttttctttctttttccttggattaaatgtgaaagcaaaaaaaaaaaaaaaaaaaaaaaaaaaaaaaaaaaaaaaa

SEQ ID NO: 220 - DNA, 1634 bp, Homo sapiens
cggaggagagcgcaggaggaaacagtaccggctggaggccggtcttgcaggagcgggggactgctgggggcggggcttggtggtgactgctggcggggcggggcctggggctcagaggggtgggctttggagatcagagggtcgacgctgcttcgttgcctggactctggtttccgccctggagcaagccggggcctggtcggcagctgggccgccatggagtccacgctgggcgcgggcatcgtgatagccgaggcgctacagaaccagctagcctggctggagaacgtgtggctctggatcacctttctgggcgatcccaagatcctctttctgttctacttccccgcggcctactacgcctcccgccgtgtgggcatcgcggtgctctggatcagcctcatcaccgagtggctcaacctcatcttcaagtggtttctttttggagacaggcccttttggtgggtccatgagtctggttactacagccaggctccagcccaggttcaccagttcccctcttcttgtgagactggtccaggcagcccttctggacactgcatgatcacaggagcagccctctggcccataatgacggccctgtcttcgcaggtggccactcgggcccgcagccgctgggtaagggtgatgcctagcctggcttattgcaccttccttttggcggttggcttgtcgcgaatcttcatcttagcacatttccctcaccaggtgctggctggcctaataactggcgctgtcctgggctggctgatgactccccgagtgcctatggagcgggagctaagcttctatgggttgactgcactggccctcatgctaggcaccagcctcatctattggaccctctttacactgggcctggatctttcttggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatagcctgccttgtgctggccatggggctgctgggccccctggactggctgggccacccccctcagatcagcctcttctacattttcaatttcctcaagtacaccctctggccatgcctagtcctggccctcgtgccctgggcagtgcacatgttcagtgcccaggaagcaccgcccatccactcttcctgacttcttgtgtgcctccctttcctttccctcccacaaagccaacactctgtgaccaccacactccaggaggcagccccatccccttccagcccctaagtaggccctcccctccctaaatctgcttccgcaccacctggtcttagccccaaagatgggccttctctctcccagataagttggtcctccctctgcctttcctctcaagcccccaaagagcaaaggcaacagcaagaccagcgggttcttgcaacactgtgaggggcagccagggcggccccaataaagcccttgaatactttgaaaaaaaaaaaaaaaaaaaaaaaaaaaaaaaaaaaaaaaaaaaaaaaaaaaaaaaaaaaaaaaaaaaaaaaaaaaaa

SEQ ID NO: 221 - DNA, 1634 bp, Homo sapiens; identical to SEQ ID NO: 220

SEQ ID NO: 222 - DNA, 1694 bp, Homo sapiens
caagtattttgcttcgatgatttcacgtcatcttcaaaacaacctcatgagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagaggcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggatcgctgggccctaggctcttgcttctggggctattggagggtcagtgtctgtgactgaataaagttccattttgtggtcctgcaaaaaaaaaaataaaaaaaaaaaaaaaaaaaaaaaaaaaaaaaaaaaa

SEQ ID NO: 223 - DNA, 2444 bp, Homo sapiens
cccgccccgaagtttgaggggtgtggacggtttgtgacccccttagccgaccctactcctcactggccgggacaactggtcttatcacggaggctgggaccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttcttttcctgtaaatcatggttaatgacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagacttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtgttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggagtgaagattgtgccagccttctcctatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggtcaaaagaaaaaaaaaaaaaaaaaaaaaa

SEQ ID NO: 224 - DNA, 2178 bp, Homo sapiens
gtagtctgagcgctacccggttgctgctgcccaaggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcaaaaaaaaaaaaaaaaaaaaaaaaaaaaaa

SEQ ID NO: 225 - DNA, 6622 bp, Homo sapiens
atgggtcgcatggaaatggagcttgattatgctgaagatgctaccgaacggcgccgtgtcctagaagtagaaaaagaagacacagaagagctgagacaaaagtacaaggattatgttgacaaagagaaggcaattgccaaagccttggaagacctcagagccaacttttattgtgaactgtgtgataagcaatatcagaaacatcaggaatttgataaccatatcaactcctatgatcatgcacacaagcagggccatgaaggaatgcaaagcctcacatactactttcagcaggctgaccagataaaagtggtcagactgagattaaaagatctgaagcagagagagtttgctcgaaatgtctcttcaagatcccgcaaggatgagaaaaaacaggaaaaagcccttcggcggctccatgagttggcagagcaaagaaaacaagctgaatgtgcacctggaagtggtcccatgttcaaaccaaccacagtggctgtagatgaagaaggtggagaagatgataaagatgaatcagctacaaatagtggcacaggtgccactgcttcttgtggcctgggatctgaattctccacagataaaggaggccctttcactgcagtacaaatcactaataccactggactggcccaggctcctgggttagcctcccaaggcatcagctttggcattaagaataatctggggaccccattgcaaaaattgggagtgtcattttcttttgccaaaaaggctcctgtcaaactcgaatcaatagcatcagttttcaaggaccatgcggaggaagggacctctgaagatggaacaaaacccgatgagaagagttctgaccaaggactgcagaaggtaggagactctgatgggagcagtaatcttgatggtaaaaaagaggatgaagaccctcaggatggagggtcccttgcctcaacattatccaaattaaaaaggatgaaacgagaagaaggagctggggctacagagcctgagtattaccactacatccccccagcacactgcaaagtaaaacctaattttccctttctactttttatgagagccagtgaacaaatggatggtgataatactacacacccaaagaatgccccagagagtaaaaaaggcagttctcccaagcctaaaagctgcatcaaggcggcagcaagccaaggagcagaaaagacagttagtgaagtctctgagcagccgaaggaaaccagcatgaccgagccctcagaaccaggaagcaaagctgaggcaaagaaggccttaggaggggatgtaagtgatcagagtttagaaagtcatagtcagaaggtttcagagacccaaatgtgtgagtccaactcttctaaagaaacctctctggccaccccagcagggaaagaaagccaagaaggacccaaacatcctactggtcccttcttcccagttttgagcaaagatgaaagcactgccctccagtggccatcagaactattaattttcaccaaggcagaaccctccatttcatacagttgtaaccctttatattttgactttaaactttcaaggaacaaagatgccagaactaaaggaacagaaaaaccaaaggatataggaagctcctcaaaggaccatctccaaggcctagatcctggtgagccaaataaaagcaaggaagtgggcggagagaaaatagtacgttcctcaggaggcagaatggacgcacctgcttcagggtctgcctgtagcggcctgaacaagcaggagcctgggggtagccatgggtctgagacagaagacacagggagaagccttcccagcaagaaagaacgatctgggaagtcccaccggcacaaaaagaaaaagaagcacaaaaaatccagcaaacacaaacgtaaacacaaggctgacacagaagagaaaagctctaaggcagagtcaggggagaaatctaagaagcgcaagaaacgaaaacgaaagaagaataagtcatcagccccagcagattctgaacgaggacccaaaccagaaccccctgggagtggcagtcccgcaccaccaagaagaaggcggagagctcaagatgactcccagcggagatccctcccagctgaagaggggagcagtggcaaaaaggatgaaggtgggggtggtagcagctcccaagaccatggtgggaggaaacacaaaggtgaacttccaccttcatcctgccagcgaagagcaggcaccaaacggagcagccggtctagccatcggagccaacccagtagtggagatgaggatagtgatgatgcttcctcacaccggctgcaccagaagtctccatcccagtacagtgaggaagaagaagaggaagattcaggcagtgagcattcccgcagccgctcaaggtctggccggcgccattcctcgcatcgttcctcccggcgttcttactcaagtagctcagatgcctcttcagaccagagctgctatagtagacagcgcagttactctgatgacagctacagtgactacagtgacagatcacgaaggcactccaagcgctcccatgactcagatgactcagactatgccagctccaaacaccgatcaaaacggcacaaatattcatcttctgatgatgactatagcctcagttgcagccagtcccgaagccgatctcggagtcataccagagagcgctcaagatcccggggccgcagccgcagcagcagttgtagtcgtagtcgaagcaagcggagaagccgtagcaccacagcccacagctggcaacggagccggagctatagccgggaccgcagccgcagcaccaggagcccttcccagagatcaggctccaggaagagatcatggggtcacgagagccctgaggagaggcattctgggcgtcgggacttcattcgttctaagatctaccgctcccagtccccccactatttccgatcaggccggggagaaggtcctgggaagaaagatgatggcagaggagatgacagtaaagcaacaggtccaccttcccagaacagcaacattggcacaggaagagggtcagaaggtgactgcagtcctgaagacaagaactctgtcactgccaaactgctactggagaagatccagtcaaggaaagtggagaggaaacctagtgtgagtgaggaggtgcaggccacccctaataaagctgggcccaagctcaaggaccccccacaaggttactttgggcccaagctccccccatctcttggcaataagcctgtccttccactgatagggaagctcccagctacccgaaagcccaataagaagtgtgaagagtctggcttggaaaggggggaagagcaagaacagtcagagacagaagaggggcccccagggagtagtgatgccctatttgggcatcagttcccttcagaggaaacaactggccccttattagacccacccccagaagagtcaaagtctggagaagctactgctgatcaccctgtggctccactaggcaccccagcacattctgactgctaccctggggacccaaccatctcccataactacctccccgaccccagtgatggggacaccctggagtccctggatagcagcagtcagccaggccctgtggagtccagcttgctgcctatagcaccagaccttgagcatttccccagttatgcacctcccagtggggatcctagtattgagtcaacagatggggctgaggatgcttcactggcccccctggaaagccagcccatcaccttcacccctgaggagatggagaagtacagcaagctccagcaggctgctcagcaacacatccagcagcagcttctggccaagcaagtaaaggcctttccagcctcagctgccctggccccagccacaccagccctgcaacccatccacattcagcagccagctacagcctctgccacctccatcacaactgttcagcatgccatcctacaacatcatgctgccgcagctgctgccgccatcggcattcaccctcacccccatccccaaccacttgcccaggtgcatcatattccccagccccatctgacccccatttctttgtcccacctcactcactcaatcatccctggccaccctgccacctttctcgctagccatcccatccacatcattcccgcctcagccatccatcctgggcccttcacctttcaccctgtcccacatgctgccctctaccccaccctacttgctccacggcctgctgcagcagctgccactgcacttcaccttcacccactacttcaccccatcttctcaggtcaggacctgcaacatccccccagccatggcacgtgagttgggggatgggatcctaggtagggccaggggaggagacccataaatgttcccttgggggtgttgagccattaataccagcaagtagaagctgggatgggcagtgtctgacagccaaagaattgagttttggcttgcaggggtgggtttagatttgaagtttgctttcagtttactatcagggatttctttttcctgtcctcctctcaatttgtccctccctcttctgtgtttctaagctagggaacaccagtaagtgctacccacccctctgcagcaacatctccaaactgtcaagtttagataatcccctcctccctctgcttttttcctctgctcttcccttctgtaaattttaaaacattttcctcccctctggccagtgggttgtcaccagagcacttgctgtgggcccatctggtcttgccttctcagcgccacagggaaggccaagctgttctagtggtggaagtgccaccattttggggtagtatctttgaccatctttggtgacgttacgttatcccaggtgaggtggaaagcgtctcacctggaacctgatataactcaggctgcaattccatccagttcccacatcaacggagccacacatttggcactgttatcttggtatccctcatcccagaagaggcatctccatatcccagaaaagaagatcctatcatgaataaaagctgtatggcccagagaggagctcatgtgtctaaagtgaagggtatattttcttctgttgtgttgatgtttccttcttaatttataggatttttttaatgtaaaaaattgcactgaactctataaacgtaaatgctgctttttgtagctcatataaaaaaggttccatatttgtagtatactgcaataatattttttacatccagctctttaagtgatcctcgttctggtggctttgtgtaaatatgtttgccctagttgaattaagaaactctaaaggttataaaatgaaaacaaaaaataaaatatttgttttctgctagatgcaaaactgactaagcatgtatattttaccaaacttatgtattttttgaagttatgaactataaaatgttaaaacattttttgctgggacaaaatgttaagtaatttgcagtatgtagtgcccccagtattgggatttttgagctaatgggcagcagtcagctgggggcttctgagggatgctcatctttaacagtctccctcatgtacttttgctgttttacacagagaaacaggtagaccccacagaggagaaggaggggattcaacagctttattgtctggaagcagtgagatttggtgattgtctggggggattcctgggtttccctgggtaccttgttccaggcagtcagtccatttgccttcctagtacttagccccctctgacaattttttttttaatgtgccttttgggttggtagaaacggaagtagaagtaggctggaggatgagttgggacagtcttccttttgttgggaggtgagcacatttacagatattttgcttcatagtttccatgccctctgcccagctcagtttagacagtaaacgttccttgtttcttttctcccatgacactgacaagaggaattaccacctcagcctcttttgcccctcttcttgcctttcacccaggctctcagccctaattaacacactgacccaaaggtgcttgtgttgcaggtcccatctcctttgatgaggttaacaattcccactttggcattttcctaactattcgtgtggctagaattggttggttggtcacttgacaagaaaaaccatacttacctgggccaaggctctgttcctgccttcgcaaattctcaaaagagtaaagtttatgaaaagaaagtggcaggcaaacacaactcttgactgccctcccaccctcctacctgttcagtactcatctgattcagaagcatcacttcttggataactagcactggaaaaatgaaatcatctgtgtaagtgaagggactcatttttctttgctttcagcccatgtaaataaataatacagtattaacattttcgtgctgcttcccattagcttgtagattgagccatactctggctgcctctttgccttcctaggggcattttctttaacttccagaatagtgattttaaaagtaaaaataaaaataaaccttacttacaagcataacagattgtatttaactttatcacatatgatagagatatatatgctgtaaaatgagggaaaggaactttctaataaaccaatgatttgtgg

SEQ ID NO: 226 - DNA, 4903 bp, Homo sapiens
ctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacttgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatctagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccatcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaacaaaaaaaaaaaaaaaaaaaaa

SEQ ID NO: 227 - DNA, 3624 bp, Homo sapiens
gcaggttgggagggaaagtcgggggaggacgcggaagaggagctgtgggaagggggaggagggagggaggaaaagaggaggagacggaggagaactgagcagagcagagcatcgagccaaaggggagatgagtttgtctgtcctctgctgaggctacggccgggcctagggaactgggagcttgggtggaagcgacacccgtggaagtgggaggaggtggcgccgggactttaaccccttgtgggctctgcggcaggggatttaaccctttgtggatctggcccctcggaggcagcgtcatcggtagttttaaccccttcggggctgggtttcacgcactggacttaccctcatcaccttgctcaccaactcctttattggggtgctccgcttggaggtttgaggcccacctccgcccattacgtactgttcctgccgctgcacccccttggacccgctagctggccgcactgtgggcgcttaaccctttactgacttgagctccccagattgcagttggagtttgctgatagaaggactagctaaaggcgtcactgcaggaattacaaactgaagaggactctgttggactgttttttttttctttttcttttttttaagaaaaacccatttttttccttaaggacttactagccaaaatttcttaaacttcgaggactctactagccatggccgagccattcttgtcagaatatcaacaccagcctcaaactagcaactgtacaggtgctgctgctgtccaggaagagctgaaccctgagcgccccccaggcgcggaggagcgggtgcccgaggaggacagtaggtggcaatcgagagcgttcccccagttgggtggccgtccggggccggagggggaagggagcctggaatcccaaccacctcccttgcagacccaggcctgtccagaatctagctgcctgagagagggcgagaagggccagaatggggacgactcgtccgctggcggcgacttcccgccgccggcagaagtggaaccgacgcccgaggccgagctgctcgcccagccttgtcatgactccgaggccagtaagttgggggctcctgccgcagggggcgaagaggagtggggacagcagcagagacagctggggaagaaaaaacataggagacgcccgtccaagaagaagcggcattggaaaccgtactacaagctgacctgggaagagaagaaaaagttcgacgagaaacagagccttcgagcttcaaggatccgagccgagatgttcgccaagggccagccggtcgcgccctataacaccacgcagttcctcatggatgatcacgaccaggaggagccggatctcaaaaccggcctgtactccaagcgggccgccgccaaatccgacgacaccagcgatgacgacttcatggaagaagggggtgaggaggatgggggcagcgatgggatgggaggggacggcagcgagtttctgcagcgggacttctcggagacgtacgagcggtaccacacggagagcctgcagaacatgagcaagcaggagctcatcaaggagtacctggaactggagaagtgcctctcgcgcatggaggacgagaacaaccggctgcggctggagagcaagcggctgggtggcgacgacgcgcgtgtgcgggagctggagctggagctggaccggctgcgcgccgagaacctccagctgctgaccgagaacgaactgcaccggcagcaggagcgagcgccgctttccaagtttggagactagactgaaacttttttgggggagggggcaaaggggactttttacagtgatggaatgtaacattatatacatgtgtatataagacagtggacctttttatgacacataatcagaagagaaatccccctggctttggttggtttcgtaaatttagctatatgtagcttgcgtgctttctcctgttcttttaattatgtgaaactgaagagttgcttttcttgttttcctttttagaagtttttttccttaatgtgaaagtaatttgaccaagttataatgcatttttgtttttaacaaatcccctccttaaacggagctataaggtggccaaatctgagaacaattaaattcattttagttataataaatttaatatttgtaaatgtaacatagtttcagtgtgatttctagagctaattcaaaatagtattgatatattttatgtgactgcatttttggggaggggtaccgaaatcgttaaatttgtcagtttgcaaaaatatcaatctttaatgggagaattttcaatttgccaattttttccttgaatgggtttaagtatgctacaatatacagttcaggcaaaatttaagatgtaattatcttcaatacttaagtgtgcttgctttctagtgccttggttttctttcttgatgctggaaaaataaacaaaccggtattgagtgtttaggcgagtggaaagtggctacaatccaaaattttaaatttaactctgcctcggccattcaaaagtctaataacaaaaaatgtaaacctaatttggcagtttgttaggttagacaactgacagcctcatttcattcctacaagttggttttcagtaatctcttccttccccccagtaaggctggaagaggctcttggcaaacttcttagcgcaagcaatggttagattaatttgtgaggcagctctttaagacgttcagaggtaagaaatactggatttataaagcaaatggctgtttgggggattccaaggatttacctaattgtccaattctacgtgctctctataccaaaacaaaaaaaaagctatccacctttccatgtgggtcaaactaaaattagaaatgtcccctcactgcagatcaaatgtaaagcttccagttaaggagctaaatgaggtcctcagctgaatgaggaaccctgtacatccccttgcacagccctattctaaatcgcttaaactatgctgatagctgcttaggttcttgagtagttctgctcttaaacgtagggaggccctgagaactaaattttgccccaaaataaaaacagaaattatgagattgcctcctgtcattttggttaacccagtccttcacctgccctgtgtcagtgtcttctgagggcaattgcgttgctcaaatcactagcacagaggttccttaatttggggccttagaaaccattgtgggccttggggtccatgaaccccatgaaattatttgtagacttgtatgtacatttttctggggagaaggttcaagagattcataagattgtcaaactccttgaaggttcagaacctctgcagggaagggggaagaaaaccctcccattaggaagcatgcttttgcagttaaatggcgatggtggaggtgatagggacttcaagagtaaaatgcaccttgtattgcataagaagcatacacaaatcaataaatcaagggagattataccagtaggactgaatcagggccttcaaagctggactgagttggtcctgttctggcacatatggtccactggagacaatgtatgattgagcttttctttggtctaaaaattatattaaacatttattttgaaaaaaaaaaaaaaaaaaaaaaaaaaa

SEQ ID NO: 228 - DNA, 1773 bp, Homo sapiens
cacattccagaaaaaaataccgctttcacaaaactcgctccgcatgacccacagaacacccaaggtcaaaaagagtccaaagttcagaaagaaaagttatctgagtagactgatgctcgcaaacaggcctccgttctctgcagcgaagagcctcataaattccccttcacaaggggctttttcatccttaggagacctgagtcctcaagaaaacccttttctggaagtatctgctccttcagaacattttatagaaaccactaatataaaagacacaactgcaagaaatgccttggaagaaaatgtttttatggaaaacactaacatgccagaagtcaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctcagtttgaaattcagctaacccagcagctacagtcccttatccccaacaacaatgtgagaaggctcatttctcatgttatccggaccttgaagatggactgctctggggcccatgtgcaagtgacctgtgccaagctcatctccaggacaggccacctgatgaagcttctcagtgggcagcaggaagtaaaggcatctgagatagaatgggatacggaccaatggaagactgagaactacattaatgagagcacggaagcccagagtgaacagaaagagaagtcgcttgagctcacaaaagaagttccaggatacggctatactgacaaactcatcttggcattaattgtgactgaaatactaatgattttgattatacttttctgcctcattgtggtttaggattgggtgtgtgtgtctcctctctgaatggcactcaaatgtttgctgactcctactctgcgtgactggggtgtacagctatggactgatgcatcccatcccatcatctttcacgagcaaagcagtctcttttttgacagctgaagaagaacctgtagggaatccagaaggagcattcatgaaggtgttacaagcccggaagaattacacaagcactgagctgactgttgagccggaggagccctcagacagcagtggcatcaacttgtcaggctttgggagtgagcagctagacaccaatgacgagagtgatgttatcagtgcactaagttacatttgccatatttctcagcagtaaacctagatgtggaatcaatgttactaccgttcattaaactgccaaccacaggaaacagcctggcaaagattcaaactgtaggccaaaaccggcaaaaagtgaatagagtcctcatgggcccaatgagcatccagaaaaggcacttcaaagaggtgggaaggcagagcatcaggagggaacagggtgcccaggcatctgtggagaacgctgccgaagaaaaaaggctcgggagtccagccccaagggagctggaacagcctcacacacagcaggggcctgagaagttagcgggaaacgccatctacaccaagccttcgttcagccaagagcataaggcagcagtctctgtgctgacacccttctccaagggcgcgccttctacctccagccctgcaaaagccctaccacaggtgagagacagattgaaagacaacacacactatttccattttagaaagtgcaaaggctagagttacaaatatgaaggcttctaaaccaatttcacattccag

SEQ ID NO: 229 - DNA, 826 bp, Homo sapiens
aactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcggacctctgtggcagcattttttccagaacacaaaagagctatcagcttcccagtttgcacaattcatcaagaaattatgcggggtcaccggcacaaatgatgaggcatctcctggaaagcttaacttcttatccatcccatctcttggacagatgatgccagttaattactttgaataaatatgggcaaaagcttatcattatcaacaaatgagaagaaagaaaccctatgccaggtaacaccaaagctttggcccagtgccctctgttgaaacatcctaggctttttctttccactcctattacaactgatctgatttggccccttcacacctcactcctagattttgctagacctttctattttgtctccctgaattaagcttttccttttggacactttacatatggattctaaaacaatcctctgcatgtctacacttgcacataatgcaaaaaacaaaataaaataatcttcctgttttgatcaaaaaaaaaaaaaaaaaaaaaaaaaaaa

SEQ ID NO: 230 - DNA, 5190 bp, Homo sapiens
agaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagtttctcctatggagcatgaactttccatcagtgagcagcagcagccagttcagccttctgagtcttctagggaggtcgaatcttctctgacccagcaggagaccccaggtcagcctccagaacatcatgaagtcacagtttcacctccaggtcaccatcaaactcatcatttagattcacccagtgtctctgtgaagcctccagacgtgcagctcaccatagcagcagagcctagtgcagaggtgggaacttctctagtccaccaggaggctacagctcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccatgacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacccactacggaggttggacattctacagccccgaagaggactatagtttctccaaagcatcctgaggtgacacttcctcatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacagaggagacctcaactcagcctccagacctgggacttgccatcattccagaacccactacagagactggacattctacagccctggagaagactacagctcctcatccagaccgggttcagactctgcatcaaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggactgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagggaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggggcattttcagatttctgccatggaggggatgctcttcgcgaagggagagtcaggatggactttcctcatttggacagccgctctggtttaaagatctgtacaaacctctcagtgccacaagaataaataatcatgcatggaagctgcacaagaagtcatctaatgaggacaagatcctcaacagggaccctggggacagcgaagccccaacggagggggaggagagtgaagccctgccataggaggagaacacagcccacctcaggcctcctgcaaaaatacatagaataaacaacaacagttactaaacgaaaaaaaaaaaaaaa

SEQ ID NO: 231 - DNA, 3960 bp, Homo sapiens
gcgggggcgggctttgccgagcgcagagctgcagccgccgagccggacgtgtgcgcgaagatggcgggccggagcatgcaagcggcaagatgtcctacagatgaattatctttaaccaattgttcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaagtctccttatatacatttgacaaagccaaacagtgtattggcacaatgaccatcgagattgatttcctgcagaaaaaaagcaatgactccaacccttatgacaccgacaagatggcagcagaatttattcagcaattcaacaaccaggcctactcagtgggacaacagcttgtctttagcttcaatgaaaagctttttggcttactggtgaaggacattgaatccatggatcctagcatcctgaagggagagcctgcgacagggaaaaggcagaagattgaagtaggactggttgttggaaacagtcaagttgcatttgaaaaagcagaaaattcgtcacttaatcttattggcaaagctaaaaccaaggaaaatcgccaatcaattatcaatcctgactggaactttgaaaaaatgggaataggaggtctagacaaggaattttcagatattttccgacgagcatttgccttccgagtatttcctccagagattgtggagcagatgggttgtatacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggaggcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggaatgaccaatagaccagatctgatagatgaggctcttcttagacctggaagactggaagttaaaatggagataggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggccagtactaaagtggaagtggacatggagaaagcagaaagcctgcaagtgacgagaggagacttccttgcttctttggagaatgatatcaaaccagcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggccctcctcacagtgggaagactgctttagctgcaaaaattgcagaggaatccaacttcccgttcatcaagatctgttctcctgataaaatgattggcttttctgaaacagccaaatgtcaggccatgaagaagatctttgatgatgcgtacaaatcccagctcagttgtgtggttgtggatgacattgagagattgcttgattacgtccctattggccctcgattttcaaatcttgtattacaggctcttctcgttttactgaaaaaggcacctcctcagggccgcaagcttcttatcattgggaccactagccgcaaagatgtccttcaggagatggaaatgcttaacgctttcagcaccaccatccacgtgcccaacattgccacaggagagcagctgttggaagctttggagcttttgggcaacttaaaggataaggaacgcaccacaattgcacagcaagtcaaagggaagaaggtctggataggaatcaagaagttactaatgctgatcgagatgtccctacagatggatcctgaataccgtgtgagaaaattcttggccctcttaagagaagaaggagctagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgcaggctaaagtgattccttcttgctcagtccctctgggtgggaaccatccagtacttgtggacactacacgtttcaacctctctactagcaccatcacccttgaaaactctcagtcagtgtcatgaatgttgcatgacaacagttggccgattagaaggcagactttctacatgcaaatctggcttagtaaatcgaggtgtgggccagagatcctctgacagctgtcctgagctaacactaaaagtcactgggtatttggttaaaggtctcccacaagactggtattctctttgcctgaagaaacaaggcattgaatctctaaaatgctgttctcaatcattgtcagagatgttttcaagttgcagtcagaagatctttcttaatagaaagtcagatgactaccgtgttggttgtgacttccccttaagtataactaatttgctctgtggtaagagatatgctcattattaccacttagaagatgttgttaaaaacatgtgaaagataggtatggaaaaagcatacacccccaaacagaaaggagttattaaagtaatttacaaacctctcagcactaattagtgtccaactccaagtgggtcaattccttagtataatattaaggcttactagtatcactgctttttccttagcttaatgacttacttagaatttatcctttattttaaatgatctgtactatctagtgtctaaaacactattctccagaaaaatcaatcattttctagccctctccctcagtcctttattgtccattccaatacattgaacacatttcctttaccctccacacacttcttccaaaaggaagcacccgttgagtccttttgagggtgatttgtcttacaactgactgacttagcaggaatttaattaggtcatatttggtgatgagacttatggagtgtgcctctctctcccaactgctgcttaaaatgcaaggacaagcaattagaagccatcctaaggtgcttacctcacacgccacccatgaggcttgtggccacagtggcacttgggtgtggctcctctgttatttgtcctcatgtgagaaagcagatcatctccaaatcttgccatttgtatacttttggtggagacttggatgtcatatcttctttgttttgggttttcttccctagcttattttgtggcttttaaagaagtggattgtattgtgagatcctgtgattcctggtggccagtatcctggattcctctaagatcttgcctctttcctcctcatgaaagcagcacacattgtgttaacttatgtctcttgttaaatgagcttaatgtctttgtgttttgtccaaaactgtattgaaaaaatattgtttaatgcaaatgaaggaatgcaataaagagtaaatatacttgaaaaaaaaaaaaaaaaaaaaaaaaaaaa

SEQ ID NO: 232 - DNA, 1506 bp, Homo sapiens
gcgcttctgacaagcccgaaagtcatttccaatctcaagtggactttgttccaactattgggggcgtcgctccccctcttcatggtcgcgggcaaacttcctcctcggcgcctcttctaatggagccccacctgctcgggctgctcctcggcctcctgctcggtggcaccagggtcctcgctggctacccaatttggtggtccctggccctgggccagcagtacacatctctgggctcacagcccctgctctgcggctccatcccaggcctggtccccaagcaactgcgcttctgccgcaattacatcgagatcatgcccagcgtggccgagggcgtgaagctgggcatccaggagtgccagcaccagttccggggccgccgctggaactgcaccaccatagatgacagcctggccatctttgggcccgtcctcgacaaagccacccgcgagtcggccttcgttcacgccatcgcctcggccggcgtggccttcgccgtcacccgctcctgcgccgagggcacctccaccatttgcggctgtgactcgcatcataaggggccgcctggcgaaggctggaagtggggcggctgcagcgaggacgctgacttcggcgtgttagtgtccagggagttcgcggatgcgcgcgagaacaggccggacgcgcgctcggccatgaacaagcacaacaacgaggcgggccgcacgactatcctggaccacatgcacctcaaatgcaagtgccacgggctgtcgggcagctgtgaggtgaagacctgctggtgggcgcagcctgacttccgtgccatcggtgacttcctcaaggacaagtatgacagcgcctcggagatggtagtagagaagcaccgtgagtcccgaggctgggtggagaccctccgggccaagtactcgctcttcaagccacccacggagagggacctggtctactacgagaactcccccaacttttgtgagcccaacccagagacgggttcctttggcacaagggaccggacttgcaatgtcacctcccacggcatcgatggctgcgatctgctctgctgtggccggggccacaacacgaggacggagaagcggaaggaaaaatgccactgcatcttccactggtgctgctacgtcagctgccaggagtgtattcgcatctacgacgtgcacacctgcaagtagggcaccagggcgctgggaaggggtgaagtgtgtggctgggcggattcagcgaagtctcatgggaagcaggacctagagccgggcacagccctcagcgtcagacagcaaggaactgtcaccagccgcacgcgtggtaaatgacccagacccaactcgcctgtggacggggaggctctccctctctctcatcttacatttctcaccctactctggatggtgtgtggtttttaaagaagggggctttctttttagttctctagggtctgataggaacagacctgaggcttatctttgcacatgttaaagaaaaaaaaaaaaa

SEQ ID NO: 233 - DNA, 890 bp, Homo sapiens
gttccgaggaagccagagccggagccgtggcctgccgggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtggaaaaaaaaaaaaaaaaaaa

SEQ ID NO: 234 - DNA, 890 bp, Homo sapiens; identical to SEQ ID NO: 233

SEQ ID NO: 235 - DNA, 4177 bp, Homo sapiens
tctctcccccgccccccaggctcccccggtcgctctcctccggcggtcgcccgcgctcggtggatgtggctggcagctgccgccccctccctcgctcgccgcctgctcttcctcggccctccgcctcctcccctcctccttctcgtcttcagccgctcctctcgccgccgcctccacagcctgggcctcgccgcgatgccggagaagaggcccttcgagcggctgcctgccgatgtctcccccatcaactacagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagagcaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaatagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtg

SEQ ID NO: 236 - DNA, 4205 bp, Homo sapiens
ctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattctcaacttcaagtcattgcagtttctttttcccagaaaacaaggggttagatgttgcatttcataaaactaaccgaagttctgtctactgatgcagcacaagagatgtaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataaattaaatgttcaaacaatctgataaaataaccatttggaaactgaaaa

SEQ ID NO: 237 - DNA, 2396 bp, Homo sapiens
aaatccttccttccccggggtagaagtccagggtgagaaattggttccgaactcaaaggaacccagtgccgggccacagccgggtcacgtggccggcggccccccatgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagaggcatttgaggagactcatctgacctcccttgacccagtgaaacagtttgctgcctggtttgaggaggctgttcagtgtcctgacataggggaagccaatgccatgtgtctggctacctgcaccagagatggaaaaccctctgctcgcatgttgctgctgaagggcttcgggaaagatggcttccgcttcttcactaacttcgagagtcgaaaaggaaaagagctggactctaatccctttgcttcccttgtcttctactgggagccacttaaccgtcaggtgcgtgtggaaggccctgtgaagaaactgcctgaggaggaggctgagtgctacttccactcccgccccaagagcagccagattggggctgtggtcagccaccagagttctgtgatccctgatcgggagtatctgagaaagaaaaatgaggaactggaacagctctaccaggatcaagaggtgcccaagccaaaatcctggggtggctatgtcctgtaccctcaggtgatggagttctggcaaggtcaaaccaaccgcctgcatgaccggatagtctttcggcggggcctacccacaggagattcccctttggggcccatgacccaccgcggggaggaagactggctctatgagagacttgcaccttaactctgggacctgctggcccagagtggagctagggctaggtgtcaagagagggtgtgggattgggacccaggcccttctttctaaactcaacccatttccctccctaccccttatcttcaggactcttcagagctaatcctctaagttctctgtactcagttggttctcagttagctggttaagtggagtgtaatggtggcgtagagaatcacaaatggaaaataattccataattatttttttgaccttgcctatgattgattaggatagctccctctaggggtagcagccggtgtgactccctttctggtgacagacagggccccagcagccctgtctgttaccatgtgagtcatactggccaaagcttagtcctagcatatgcacctgagccaacctggccaatcagattgttttgtcaataatttgaaatttgaactggagagatccagaaccttgggagtcattaaagccaagtcattcatagcagccaggaaacaataggaaccaaaagcctctgcctgctgctattgcaattcccaggatctctccttccctggatccctccctcccaggtctgggctgtgcagttcctccccctgccttaaaacaccccactatctctgtaaagtctctctctctctttttttttttttacttaatctagctagaatctatttctgttgattacaacttaactaactcatttacggataggactttttttttttctttttttcttttttcttttctttttttttttgagatggagtctcactctgtcacccaggctggagtgcagtggtgtgatcttggctcactgcaacctctgcctcccaggttcaagcaattctcctgcctcagcctcccaagtagctgggactacaggcacacgccaccacacccaactaatttttgtatttttagtagagatggggtttcaccatgttggccaggattgtctccatctcttgaccttgtgatccacccacctcagcctcccaaagtgctgggattacaggcatgagccaccacacccagcgagacggggtttcattatgttggccaggctggtctccaactcctgacctaaagtgatctgcccgccttggcctcccaaagtgctgggattacagacatgagccaccacgcttggccgggatagtatatttttatagcacttcccctactgattgctgccttctctgtggctacaagggacccacagaattacagggaagttacagggaagcaggtttcatctcaatattgggagggatttcaaacaatcacacctgcctgagaaggagtgggctgtcactaggaatttttattcccagtccgtcaggaattttgtagaagggcttcatgtgctggtaccaataggacaggaagattttaatcagctttactatctatgtttttttatggaaactgtgtgtatgtatacatacattttccaaaaagaaaaattaaatgattatagagattatgtttttcagact

SEQ ID NO: 238 - DNA, 2233 bp, Homo sapiens
cgctcttcggggcccgggtggtctggaacaatgttgcttggctgggcggctgcgggatagggcggaaggggacaggcttgaggcttggataggcgtgaggaggcgcatacgaccgcacaacccgaggtttgtaactgtattcggaagacgccgggtccggctgggactgccagaggaacctggctttgcaggactacggaggagtaacgtcgagtgaattggaagagggcccagggccgcacaagcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagatgaggacaacacatgggagccagaagagaacctggattgccccgacctcattgctgagtttctgcagtcacagaaaacagcacatgagacagataaatcagagggaggcaagcgcaaagctgattctgattctgaagataagggagaggagagcaaaccaaagaagaagaaagaagagtcagaaaagccacgaggctttgctcgaggtttggagccggagcggattattggagctacagactccagtggagagctcatgttcctgatgaaatggaaaaactctgatgaggctgacctggtccctgccaaggaagccaatgtcaagtgcccacaggttgtcatatccttctatgaggaaaggctgacgtggcattcctacccctcggaggatgatgacaaaaaagatgacaagaactaacgctcctgagtaccagcccctgtcacatctgactgtgggtttcaagtgggaagggaaggagttctacttgtcttgacaccatagaggtggcttgagaagatgtcctttgaagagccagtatagtttctgtgccctgcagcagcccaagtgctttaaagccgtttcaagctgtatagtttgcacacccatcccagtggaggggaaaggggataagtgtttcaaggcaaccttttctgcactttgctgcgaaaagcaaagggccttctatgaaggacaaaacttgcagaattgggtgtgtgggagagcaaaaaaatactgtagatcttcaaagagcatctccacaacccacagccttcttcccaatagtgttaactctgcatttttacagcgtagcatgtgtgtagtttttggctattactggtgtattatttgggggagggagggatggggaggggagaaagggagatgggtagcatcattttgattaacatttggggcctgataggggaaatggtgaagcaatggaaaagaacagacaactaatgatttgcttctatgtccagaatattttacctttaaaaaaatgtcattggcaccataaataaggactgtgagagactgtttaaaagctgtgaaagtctgaaacctataagccaaggtgttccctgcctaaacttattgctgttcccacaaaggactaagcctgttcataagttaccaaagttgccattttggagatggaaattgacgaggagggaaggtcttttattggagagtatacagtacaagcagatcattctgccttagaggtgctaattcccgaaattagaagaccctttcttttccagtaatgaagttataaatatcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcaggagaagattaaactttcatattgggcagtggttcactttaaaacacacacatacacacacaaaacaattttttaagaaatcctaataagtaacatacccaaaatgctctgtcttgagtcatgagaaccatcagttcttgatattgtctagacttgcatctagagctacgttgtaaaattcttttaggcatgtgttagatttctgtgtaaactttgtttaaatgtaaacttcatactacattgtcagtttttgtcttaataaaactatagatttataaaaaaaaaaaaaaaaaaa

SEQ ID NO: 239 - DNA, 2315 bp, Homo sapiens
ccggcgtcccaagtgagtggaggggggatcccgactccagtccggggccttggccagcggagccgcgctattcggaagcgggaatcccactcagagcccgggcctgtaggggcggggcgtcccgggcacccgggattggggcgtctcccgtcgtgcaccggggcaccggcgactcacccggaaggagaagccgtgatctggctatatggtggggcgcgggcggtgtcgctgtggggagctggtgctgttctcagatgtttccttccaatgggcttttggtgtaggatgtcggagaaccaagaacaggaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctgggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactgggagtggttatgttgtatccccatcttggctggcttcagtttttgctgtagccctagagcactttgtttgtgggaggctggcctcttgcctacctccttgcatggacagggggatgaatatttactttcccacctccttgctttttctttcactgataccactgaatggaactggtgctgtgactcctgctgctggggatttatgtcccgagaccttagcctggctgagtggagcctgagacctgcacaacagctcatggtcatgcatgagagagaagtggctggccacagccagagggaacagtaacagcccaggggcctttattttgggaaaggctgtcccgggctgttactgtctcttctggttataaagcagacatgtggccatcttttccgcagggttagagtgggctcctttctttttggaatccttttcttctcctttggtagcagctccctgcctccagggcttccgccaccagcgtctctgctgtgttgcgcagtgcagtggggtgcaagggctttgtttctgcctgcctgaaagagagggctctggggatggagatgagaaacaacacgctctccttcagacaatgaggcattctgtcctcctgctgccattcttcatctccactgagagccagagctggtaggagccgagtgccacaggcattctgcattgctctactcttaggtttgtgtgtgtgatccttcccctccctgtcgcccactcctccctcctctggctatcctaccctgtctgtgggctcttttactaccagcctatgctgtgggactgtcatggcatttagttcagagtggaggggctttggcctgaaataaaatgcaagtattt

SEQ ID NO: 240 - DNA, 2402 bp, Homo sapiens
ccctcacccggcacctgcgtgcactctccggcgtcccaagtgagtggaggggggatcccgactccagtccggggccttggccagcggagccgcgctattcggaagcgggaatcccactcagagcccgggcctgtaggggcggggcgtcccgggcacccgggattggggcgtctcccgtcgtgcaccggggcaccggcgactcacccggaaggagaagccgtgatctggctatatggtggggcgcgggcggtgtcgctgtggggagctggtgctgttctcaggagccagcctggatcatttgttggcagtacatattggctgaagtcagttttcatttcaagatgtttccttccaatgggcttttggtgtaggatgtcggagaaccaagaacaggaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctgggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactgggagtggttatgttgtatccccatcttggctggcttcagtttttgctgtagccctagagcactttgtttgtgggaggctggcctcttgcctacctccttgcatggacagggggatgaatatttactttcccacctccttgctttttctttcactgataccactgaatggaactggtgctgtgactcctgctgctggggatttatgtcccgagaccttagcctggctgagtggagcctgagacctgcacaacagctcatggtcatgcatgagagagaagtggctggccacagccagagggaacagtaacagcccaggggcctttattttgggaaaggctgtcccgggctgttactgtctcttctggttataaagcagacatgtggccatcttttccgcagggttagagtgggctcctttctttttggaatccttttcttctcctttggtagcagctccctgcctccagggcttccgccaccagcgtctctgctgtgttgcgcagtgcagtggggtgcaagggctttgtttctgcctgcctgaaagagagggctctggggatggagatgagaaacaacacgctctccttcagacaatgaggcattctgtcctcctgctgccattcttcatctccactgagagccagagctggtaggagccgagtgccacaggcattctgcattgctctactcttaggtttgtgtgtgtgatccttcccctccctgtcgcccactcctccctcctctggctatcctaccctgtctgtgggctcttttactaccagcctatgctgtgggactgtcatggcatttagttcagagtggaggggctttggcctgaaataaaatgcaagtattt

SEQ ID NO: 241 - DNA, 2315 bp, Homo sapiens; identical to SEQ ID NO: 239

SEQ ID NO: 242 - DNA, 2402 bp, Homo sapiens; identical to SEQ ID NO: 240

SEQ ID NO: 243 - DNA, 631 bp, Homo sapiens
ggggaagctgagggctgagaccaagggctaaagctgggaggtgagtctgtcaccttgagccgggcgagcgctgtgggccaagcaggggttgcagggcagtaggagtgcagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaa

SEQ ID NO: 244 - DNA, 3053 bp, Homo sapiens
gcgatggcggagagtccgactgaggaggcggcaacggcgggcgccggggcggcgggccccggggcgagcagcgttgctggtgttgttggcgttagcggcagcggcggcgggttcgggccgcctttcctgccggatgtgtgggcggcggcggcggcagcgggcggggccgggggcccggggagcggcctggctccgctgcccgggctcccgccctcagccgctgcccacggggccgcgctgcttagccactgggaccccacgctcagctccgactgggacggcgagcgcaccgcgccgcagtgtctactccggatcaagcgggatatcatgtccatttataaggagcctcctccaggaatgttcgttgtacctgatactgttgacatgactaagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctaggtacatggactggacctgcctggagcccagcccagagcatctcctcagtgctcatctctatccagtccctgatgactgagaacccctatcacaatgagcccggctttgaacaggagagacatccaggagacagcaaaaactataatgaatgtatccggcacgagaccatcagagttgcagtctgtgacatgatggaaggaaagtgtccctgtcctgaacccctacgaggggtgatggagaagtcctttctggagtattacgacttctatgaggtggcctgcaaagatcgcctgcaccttcaaggccaaactatgcaggacccttttggagagaagcggggccactttgactaccagtccctcttgatgcgcctgggactgatacgtcagaaagtgctggagaggctccataatgagaatgcagaaatggactctgatagcagttcatctgggacagagacagaccttcatgggagcctgagggtttagaccctgctcccatctccccttcccccactcaagagtcccagcagaatcccttccccccaccccagggatggagaggcactgtgtatctccctccagactcgaagtcatcctgcaagatggcaagaaccaagcaagctccgatcccagggtgtgggagtgggggcctgttcccggtctgacctccttggcactggagcatctggggcttcgttcatccattcatcccgtatcaggggccaaggtacctttacaggagcacctagagcgagggcctttggcaaaaacaaaacaaccaacacacctctccacagggccagctccttagggataagtggaagatggaaattgcaattccaagagggagtgtgcccaaatgatttatggggatacctggaagggagcttggggtgggggctgtctgtgacacttaagcagtctgggtggttgtctatttgtctgtcttcagtcttgaagcagggcttcccaatgcccttttcctccctgccttccttcccccattatttcccacaggccagcataattttgtttttcctaatttatagtcactgttctagacagaccaaagagaaggaacagtggtggagtctaggctgctgatcagtaagctttacctagcacctgagcacctttctcccctcccctctttcctcacccttttctagatgtaagacagaaggtaaatgtgactgggacttaaccaaggtcttggtaaagcctgcatggcaccgtaagaagctgaaaatactgtttgttcccgcaatcactgatttgaaaagttcccaacacaggcagctgctgtgtatatgggattagagccactacatagaatagtctcttacagattttcataaatactagtcacaataagggtatttttcttgggggtggagtaagggggagactgatgctagtccttgttgtattttgttgggctgtccttgtgtattttcaccccagcctgtagtcctcctcacttcaaccccagggatttgtggggagcaagggtagccaatggcagagggggttggggctgggactctggaggctcctccccttctttctcttccttctgcctcccccgtgcccccagctgctcttgtcactgtctctgatgggtatttgcctggctttgttgcttctctatctgtatttagctgcagtgatcctttagctggttggctcagaaaaaaaaaaatgtgctttaggtgccctgtaatcctgggcatcaagggaatccatccttcccctttttgatatgttctccccgtacttccagatttattgttatggctcccagtgggtattggcgattcttgtgatgcagggcctcagtcagtgtccagccatgcataagggagaggatagtgtgtacctgccctgccctctgctatgaaggtctctgccttgtggatcatgggactccccttggaggatctgtgcaaaggggggctgggcacaaaggagaatgtcctatttgggagggcaggaagcaaaggaactggacagggattggtgggcttggggaacggaagtttatcttggatacccttgaagaggctgggtctcttcacatgaagatcgaaaagggaccctgcttccaatttccctcttccattcctcgagctactccagggcttagaagaatgctcttggtctgtgggtccagtgttgtctgtcatccatttaagtgttcccactttcaagtgacaatcctctccttggccctgccatagggcagagcatgtctggcatagcagcctgacttttatgccctaatcttgagttgaggaaatatatgcacaggagtcaaagagatgtctttatatctgactgtatataaatgaagtttttttgttttttttgttttcctttttggtgcaataaagtttgttttggcagaaaaaaaaaaaaaaaaaaaaaaaaaaaaaaaaaaaaaaaaaaaaaaaaaaaaaaaaaaaaaaaaa

SEQ ID NO: 245 - DNA, 1226 bp, Homo sapiens
ccgggacgtggagacccggggtcccggcagccgggcggcccgcgggcccagggtggggatgcaccgccgcggggtgggagctggcgccatcgccaagaagaaacttgcagaggccaagtataaggagcgagggacggtcttggctgaggaccagctagcccagatgtcaaagcagttggacatgttcaagaccaacctggaggaatttgccagcaaacacaagcaggagatccggaagaatcctgagttccgtgtgcagttccaggacatgtgtgcaaccattggcgtggatccgctggcctctggaaaaggattttggtctgagatgctgggcgtgggggacttctattacgaactaggtgtccaaattatcgaagtgtgcctggcgctgaagcatcggaatggaggtctgataactttggaggaactacatcaacaggtgttgaagggaaggggcaagttcgcccaggatgtcagtcaagatgacctgatcagagccatcaagaaactaaaggcacttggcactggcttcggcatcatccctgtgggcggcacttacctcattcagtctgttccagctgagctcaatatggatcacaccgtggtgctgcagctggcagagaagaatggctacgtgactgtcagtgagatcaaagccagtcttaaatgggagaccgagcgagcgcggcaagtgctggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacctgggcaattttgtttatacaaaaaatagaaaaaaagttccaagtttttctttcttccctcattcttttatttttgaaaagtgccttcacgttgcatttttattggaggaaaacctcgctcgttcagtaagcataatctgattaacacagagaacggcaagcacatataaaatgatttttgtaggtcatctgcaagttcatggaagagctgggcctagaatgtgggttgtttcctggcctgtctagtctttgtagctgtgagacatagattacagcctatgctaattcaaaccttttaaataaaatgttccttatctcaaaaaaaaaaaaaaa

SEQ ID NO: 246 - DNA, 5368 bp, Homo sapiens
ataagatgctcccaagtcccttgcagctctcttcagaagaaaaatcactagtgctctgctcttgccataataccaaacctttttgactcatgctttggtgctgcaacactggaagaattgcacacagtttccaggaatatctttttttcatttgagtgattctttgtggatgagaaaagatttgagtcttaataattaccttgttttaaagctatttctttatagtctgaactgtttaataaattgggccacttaccaatgagccacacagccagttcttgtcaggagctggttgaaaactgtgctgtgcatgtagcaggaatggcacaagaagatagccgtcgtggtcaagtgccatcttccttttatcatggtgccaaccaagaacttgacctgtccaccaaagtgtacaaaagggaatcaggaagtccttattctgtgttagtggacaccaagatgagcaaaccgcatctccatgaaacagaagaacagccatatttcagggagacaagagcagtgtctgacgtgcatgctgttaaggaagaccgggagaattctgatgacacagaggaggaagaggaagaagtctcttacaaaagggagcagatcatagtggaggtaaaccttaataatcaaacattaaatgtatctaaaggggaaaagggtgtctcttctcagtccaaagagactcctgttcttaagacaagcagtgaggaggaagaggaagagagtgaggaagaggccacagatgacagcaatgactatggagagaatgaaaagcagaagaaaaaggagaagatagtagagaaagtcagcgttacacaaaggagaaccaggagagctgcctctgttgccgcagctaccacttcccctactcccagaactacaagaggtcgtaggaagagtgtagagccacctaagcgtaagaagcgggccacaaaggagcccaaagcaccagtccagaaagctaagtgtgaagagaaagagactctgacctgtgagaagtgccccagggtatttaacactcgctggtacctggagaagcacatgaacgttactcataggcgcatgcagatttgtgataaatgtggcaagaagtttgtcctggaaagtgagctgtcccttcaccagcaaacagactgtgaaaaaaacattcagtgtgtttcctgtaacaaatcgttcaagaaactctggtcccttcatgaacatatcaagatcgtccatggatatgcagaaaagaaattttcctgtgaaatttgtgagaagaaattctataccatggctcatgtgcggaaacacatggttgcacacacaaaagacatgccatttacatgcgaaacctgtggaaaatcattcaaacgcagtatgtcactcaaggtgcactccttgcagcattctggagagaagccctttagatgcgagaactgtgacgaaaggtttcagtacaagtaccagctacgctcccacatgagcattcatattgggcacaaacagttcatgtgccagtggtgtggcaaggatttcaacatgaagcagtacttcgacgaacacatgaaaacacacactggagagaaaccctttatctgtgaaatctgtggcaaaagcttcaccagccgccccaacatgaagagacaccgcagaactcacacaggcgagaagccctatccatgtgatgtgtgtggccagcggttccgcttctcgaacatgcttaaggcccacaaggagaagtgctttcgggtgaccagccccgtgaatgtgccacctgctgtccagatcccacttacaacttccccagccaccccagttccttctgtggtgaacacagccacaaccccaacccctccaatcaatatgaatcctgtaagcactcttccccctcggcccatcccccaccccttctcacacctgcacatccacccacaccctcaccacccacaccaccttcccatccctccagtccctcacctcccgccacctccagctctctttaagagtgagcctttaaatcatagaggccagagtgaggacaactttctgcggcacctggcagagaagaacagttcagcacagcatcattaacatccgtctccttagtgtgttctccaggagacacgtccccatgtgtgagcgtgcacagagggagtcggtgagcatttccttagttctcagactctcctccgcctctaccaagagcttcgccagtgtcactgaatcaacagatccaagggaatgaacaagaagactaccttgagctcacagagggactgtcatctaaaccaggggaaccactgaactaaagcccaatttgcttgcattttctgatgacttttataagtttcaaatactcagacttgtggaattttataatttcatatcagctgatgaggtatgcttgcttttatatcccagacttctcctcaaagaggggataggcctggtttcctttgtactaatcgggaaggctgtgagattaatccagagcattaattgtatcactgtgtatggtaaggaattcttttcagcttttggtgccagctacagagttgagctggccatgtttcacagtatatcaagcattatagagaaagacagaaattttcttctttgtgtagctctcctaacgcactctttattttactacagaaattattttagagtttttgtatagacttctttggtagtctgtttctaaaatgaaatgtatttcaataagcagtgtaattttttcagtgtagctgaacctatgttgtaaaatagaaaaaaatttttataatcatcaaaatgtgattcttaaagatgcatataacttctataattcaaagctattcttacatccgtacaactcaaaaggtgcttcagagactagatgtatctgagagggtctccagaccaggttactgcaaaaatgaggttttgctttcaggatttggcgtaaatacttggtagttttgacatctctgcttaacactcaagagaggctccctaatgtgctcctgtcctccatgttctgcttggcttcgttagtgcattacatgaaatgatttgcaggggatggggccttttccagggaagtcacctaaagcttgcatgttttgaaaatttgaataaggctgtttgctgacaggaggaggaagtagtggagatcatttcatctcagtcacgtctgtttctcacttcccttaggaattgtgttgatgtttaacttttatgggatgacaaattgaaatcgctcattttgaggttgctttatttttctagaattgttataagaagctaaaatagtaaacttaaaatcacaaacatgacattgctgatagtggctgagaaattcagatgagaagacaaattggttatgaattttgaaatatctattatatgtaaaatgtggatatgttcacaaccttgagctattttaacacagtttaaatatagtgagggaaaactcctaagttttactgccctgtcctctgcaaattatgtaataccagcattcttaggcgataaagagagcagcacctctagtacctttaggcagattactttttcaagtttggggaacttcaaaagaccataatcaaccaggagcttattataggaaaggctgaacagaagggctagtgtattgattacacttaacagatcatatttatccagactcagtatagcttaaaattttgtatttctttatctgagagaactgagttcccaggctaaatcacttacctcccaccccctctccaattttttttttaagagacaaggtcttgctatgttgcccaggctagagtgcagtggctattcacaggtgcagttatagcacactacagcctccaactcttgggttcaagcaaccctgcctcagctaaccaagtagctgggactacaggtgcatgctaccatgcccagtccattttttaatcttgaaatttcttcatttttctttcttcggtttcttaaaatctttgcctgaatcagaacgctggcttttatttatttttttatttttaatattaaatgtgcagatatgcttcgagcacttttctaactaatgagctctgtggtaagaaaaaatgaactctttcaattgagattaagtccatatttttcaaacatcacgttctctattggctttttggtttagtgtttctaaattttctccttctgattttgcctgtcttatataatgagcataggaaaattttggaatgaggcagaaaagtatatcaagacatacttcctggttttggatgtaagttttaaagaatggtatttttaatatttgtacacattctttgagcacccaggtacccaagccaataaggaaagttaattccttgcatatgactgttatatctttagtggttgtctccctctccctccacagtctccttggcattccatgacaagtttgtcaacctacacttttatatagacatatcattatttcatggtcaagcctgtagtattaaaatgatttttttaaaagatgtaaactgtgcttagttaattggttatattttgttctgttttttttttttttttttttttttttttgaggcagagtcttgttctgttgcctgggctggagtgcagtggcgtgatcttggctcactgcaacccccgccccccgggttcaagtgattctcctgcctcagcctcccgagtagctggaattacaggcatgcgccagcacgcccggctaagttttgtatttttggcagagatggggtttcaccatattggccaggctggtctcaaactcctgaccttgtgatccgcccacctcagcctccgaaagtgctgggattacaggcgtgagccaccacgtccaactgccttattttgttctgaataaatttacagtattgggcagcaattctggattctagacttgagaccacagaatcaaccatttcatgaggttgtactgtaattatacactggaatattcaggtagtcatctttgatttttcattcaagtaaatatagccataagaaaatatctgctatacaggaaaaccagtattaagcaaataccaccatccttaacagaaacaaaaatatatatatatattatttttaaaaattagcattgtcatacagtacaattcttagtgaagtgtattgtggaacaatttagaaacttcctttttttcccctagattaaggatactttccttgacttgagacttgtggtcttcaggaaaactactcagaatataatgactcctcatcagtatcatattgtatataaataatgaaatgcattaagaatattcacaacattgaacccaggaggcggagcttgcagtgagccgagattgcgccactgcgctccagcctgggcaacagagcgagactccatctc

SEQ ID NO: 247 - DNA, 1826 bp, Homo sapiens
agtatgtgtggttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaattagtctatcaaatgaaactctttcattcttctcacatccatctacttttttatccacctccctaccaaaaattgccaagtgcctatgcaaaccagctttaggtcccaattcggggcctgctggagttccggcctgggcaccagcatttggcagcacgcaggcggggcagtatgtgatggactggggagcacaggtgtctgcctagatccacgtgtggcctccgtcctgtcactgatggaaggtttgcggatgagggcatgtgcggctgaactgagaaggcaggcctccgtcttcccagcggttcctgtgcagatgctgctgaagagaggtgccggggaggggcagagaggaagtggtctgtctgttaccataagtctgattctctttaactgtgtgaccagcggaaacaggtgtgtgtgaactgggcacagattgaagaatctgcccctgttgaggtgggtgggcctgactgttgccccccagggtcctaaaacttggatggacttgtatagtgagagaggaggcctggaccgagatgtgagtcctgttgaagacttcctctctaccccccaccttggtccctctcagatacccagtggaattccaacttgaaggattgcatcctgctggggctgaacatgcctgccaaagacgtgtccgacctacgttcctggccccctcgttcagagactgcccttctcacgggctctatgcctgcactgggaaggaaacaaatgtgtataaactgctgtcaataaatgacacccagaccttcc

SEQ ID NO: 248 - DNA, 1804 bp, Homo sapiens
cgctccgagtgtgtgtgtatttgtgtatcggcggtcccgcaggtcccggatgttgcggacagtatgaggcaagcgcagggggacggggaccagcagctgtcgccgccgctctcagatcgagtcttgctctgtcacccgggctggagtgcagtggcgcgatctcagctcactgccacctttgcctcctgggttcaagcgattcttctgcctcagcctcccgagtagctgggattacagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaaaaaa

SEQ ID NO: 249 - DNA, 1186 bp, Homo sapiens
gatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagataacaagaggaaagtatggggaaggagccaagcaggagacgttcacctttgccttaactttggtcttcattcaatgtgtgatcaatgctgtgtttgccaagatcttgatccagttttttgacactgccagggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagc

SEQ ID NO: 250 - DNA, 2398 bp, Homo sapiens
ccacgcgtccggcagcggcctcgggggttggggggctgtgtgagtctcgcagtggggctgaggcaggcagccgggagagccatggcgggggccgcagcgggcggcagaggcggaggtgcctgggggccggggcgcggaggggccggggggctccggcggggctgctctcccccagcccccgccggctccccccgggctgggctgcagccgctcagggccacgatccccttccagctgcagcagccgcaccagcgccgggacgggggtggccgtgcagccagcgtcccatgctcggtggccccagaaaagtcagtgtgtaggcctcagccacttcaggtccggcgtacattctccctggacaccatcctcagctcctaccttctgggccagtggccacgagatgctgatggggccttcacctgctgcaccaatgacaaggccacccagacgcccctgtcctggcaagagctagaaggtgagcgtgccagttcctgtgcacacaagcgctcagcatcctggggcagcacagaccaccgaaaagagatttccaagttgaagcaacaactgcagaggacgaagctgagccgcagtgggaaagagaaggagcgaggttcaccactcctaggggaccacgcagtgcggggagcactgagggcgtcccctcccagcttcccctcagggtcccctgtcttgcgactcagcccctgcctgcacaggagcctggaagggctcaaccaagagctggaggaggtatttgtgaaggagcagggagaagaggagctgctgaggatccttgatatccctgatgggcaccgggccccagctcctccccagagtggcagctgtgatcatcccctcctcctcctggagcctggcaaccttgccagctctccttccatgtccttggcatctccccagccttgtggcctggccagtcatgaggaacatcggggtgccgccgaggagctggcatccacccccaacgacaaagcctcctctccaggacacccagcctttcttgaagatggcagcccatctccagtccttgcctttgctgcctcccctcgacctaatcatagctacatcttcaaacgggagcccccagaaggctgtgagaaagtgcgtgtgtttgaagaagccacgtctccaggtcctgacctggccttcctgacttcctgtcctgacaagaacaaagtccatttcaacccgactggctcagccttctgccccgtcaacctgatgaagcccctcttccccggcatgggcttcatcttccgtaactgcccctcaaacccgggatctccccttcccccggccagccccaggccaccacctcggaaggatccggaagcctccaaggcctccccactgccattcgagccatggcagcgcaccccaccatcagaagagcctgtgcttttccagagctccctgatggtctgagggtcccacccctgccccactttaccatagagaccagtgccttggtggcaggtccctccccaggtcccctgagatggggtatggaggggcccttccctctcggccttcgagcactttctttcacttactgtgtcaaagccctgggtcctctttttgatgggcaccggcccctctgaacgtgatgggacctgccttctccactagtagctgggcagctcacaattcacacctgtgtacctgccacatccctcacttggtggaaaacacccagaaggtcttgagtcccccacccctgggtgtcagtccaaatgactgtataggaggcccttatttttgtcacagagcaagctggccatgaacgaaggagagaagacgccacagatttccttccctctcctccaggagaccataagatagatcccccatcctctcagccctattcccatgcctccctctcattggaggagctgaccaaagcagccctaacgggccataacacttgaccaattcagctgctggcagagggaggaaacaagtgttttcccaagtggcattttcatctcgctttcaccctgactaaagattgtcttaagtagcagcccagcccgcccagccccaggtgggtagtggggaggagagctggcattcctccaggtggcaaatggcgactctatactctccgcccgccccagggctggatggattagaaaaatgcctatttttcttgtatcgatgtagagactctattttctcccaaagacactatttttgcagctgtttgaagtttgtatattttccgtactgcagagcttacacaaaattgaagaatgttaatgttcgagttttcttatcttgtgtttagaggttgttttttgcagatcttggtgttaatagaccaaataaataaataaatattcccagcagcttgaaaaaaaaaaaaaaaaaaaaaaaaaaa

SEQ ID NO: 251 - DNA, 3600 bp, Homo sapiens
gaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagagaaactaaaaatacagctgatcatgatgagtcaccgcctcgaactccaactggaaatgcgccttcttctgagtctgacatagacatctccagccccaatgtatctcacgatgagagcattgccaaggacatgtccctgaaggactcaggcagtgatctctctcatcgccccaagcgccgtcgcttccatgaaagctacaacttcaatatgaagtgtcctacaccaggctgtaactctctaggacaccttacaggaaaacatgagagacatttctccatctcaggatgcccactgtatcataacctctcagctgacgaatgcaaggtgagagcacagagccgggataagcagatagaagaaaggatgctgtctcacaggcaagatgacaacaacaggcatgcaaccaggcaccaggcaccaacggagaggcagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtaccattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcccttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaaaaaaaaaaaaaaaaaaaaaaaaaaaaaaaaaaaaaaaaaaaaaa

SEQ ID NO: 252 - DNA, 4637 bp, Homo sapiens
aggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgcaattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggccagtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcgccgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccagcgccaaaacaagccaaagagcctcccaccagagccgggaggaaaaggcccctgcaatgtggtgacacctcccctttcacacctggatccatcttgagagccacagtcactggattgactttgctgtcaaaactactgacagggagcagcccccgggccgctggctggtgggcccccaattgacacccatgccagagaggtggggatcctgcctaaggttgtctacgggggcacttggaggacctggcgtgctcagacccaacagcaaaggaactagaaagaaggacccagaaggcttgctttcctgcatctctgtgaagcctctctccttggccacagactgaactcgcagggagtgcagcaggaaggaacaaagacaggcaaacggcaacgtagcctgggctcactgtgctggggcatggcgggatcctccacagagaggaggggaccaattctggacagacagatgttgggaggatacagaggagatgccacttctcactcaccactaccagccagcctccagaaggccccagagagaccctgcaagaccacggagggagccgacacttgaatgtagtaataggcagggggccctgccaccccatccagccagaccccagctgaaccatgcgtcaggggcctagaggtggagttcttagctatccttggctttctgtgccagcctggctctgcccctcccccatgggctgtgtcctaaggcccatttgagaagctgaggctagttccaaaaacctctcctgacccctgcctgttggcagcccactccccagccccagccccttccatggtactgtagcaggggaattccctccccctccttgtgccttctttgtatataggcttctcaccgcgaccaataaacagctcccagtttgt

SEQ ID NO: 253 - DNA, 4495 bp, Homo sapiens
aggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgcaattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggccagtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcgccgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccagcgccaaaacaagccaaagagcctcccaccagagccgggaggaaaaggcccctgcaatgtggtgacacctcccctttcacacctggatccatcttgagagccacagtcactggattgactttgctgtcaaaactactgacagggagcagcccccgggccgctggctggtgggcccccaattgacacccatgccagagaggtggggatcctgcctaaggttgtctacgggggcacttggaggacctggcgtgctcagacccaacagcaaaggaactagaaagaaggacccagaaggcttgctttcctgcatctctgtgaagcctctctccttggccacagactgaactcgcagggagtgcagcaggaaggaacaaagacaggcaaacggcaacgtagcctgggctcactgtgctggggcatggcgggatcctccacagagaggaggggaccaattctggacagacagatgttgggaggatacagaggagatgccacttctcactcaccactaccagccagcctccagaaggccccagagagaccctgcaagaccacggagggagccgacacttgaatgtagtaataggcagggggccctgccaccccatccagccagaccccagctgaaccatgcgtcaggggcctagaggtggagttcttagctatccttggctttctgtgccagcctggctctgcccctcccccatgggctgtgtcctaaggcccatttgagaagctgaggctagttccaaaaacctctcctgacccctgcctgttggcagcccactccccagccccagccccttccatggtactgtagcaggggaattccctccccctccttgtgccttctttgtatataggcttctcaccgcgaccaataaacagctcccagtttgt

SEQ ID NO: 254 - DNA, 2319 bp, Homo sapiens
agggcaagggtagggaggaggcggccgaaccgcgtcgctgggccgaaaggtgcgcgagcgctgcccgcgcggggaccacaacccaagtcgcggccgccgcagccatgcgctgggtgtgggcgctgctgaagaatgcgtccctggcaggggcgcccaagtacatagagcacttcagcaagttctccccgtccccgctgtccatgaagcagtttctggacttcggatccagcaatgcctgtgagaaaacctccttcaccttcctcaggcaggagctgcctgtgcgcctggccaacatcatgaaagagatcaacctgcttcccgaccgagtgctgagcacaccctccgtgcagctggtgcagagctggtatgtccagagcctcctggacatcatggagttcctggacaaggatcccgaggaccatcgcaccctgagccagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacaccctcatctttgatggcagcaccaacccagcccatcccaaacacatcggcagcatcgaccccaactgcaacgtctctgaggtggtcaaagatgcctacgacatggctaagctcctgtgtgacaagtattacatggcctcacctgacctggagatccaggagatcaatgcagccaactccaaacagccgattcacatggtctacgtcccctcccacctctaccacatgctctttgagctcttcaagaatgccatgagggcgactgtggaaagccatgagtccagcctcattctcccacccatcaaggtcatggtggccttgggtgaggaagatctgtccatcaagatgagtgaccgaggtgggggtgttcccttgaggaagattgagcgactcttcagctacatgtactccacagcacccaccccccagcctggcaccgggggaacgccgctggctggctttggttatgggctccccatttcccgcctctacgccaagtacttccagggagacctgcagctcttctccatggaaggctttgggaccgatgctgtcatctatctcaaggccctgtccacggactcggtggagcgcctgcctgtctacaacaagtcagcctggcgccactaccagaccatccaggaggccggcgactggtgtgtgcccagcacggagcccaagaacacgtccacgtaccgcgtcagctaagggccgccgtgcatctgcacctgagaggacggactgccgcctctgggtccccccaccgtggtgcccctcaccatcctcctgggggagcagggggtgggttctccctgatgaccaggttctgtctctatggaagtcactgcggtgataggtctgtgatggtccctaagtgccagtccatctctgtggagacccctcggtggcctccctatctctgtgggcgatgcctgagggttagggatgtctccaccctgatggggtgtcccagagacattttcccatggcagtcctcctctctgagaccagggctgtcacttttctgccaggggtactgggtccccctcagcaccctccacagcacaggccttccaagtggatgtcccgttgccttattcccccagcccacaaaggcaccctggccttggtctgctgaagtgttaggaagagggtgggtgccctccagacctggggactgagtggggaaaggagttacacccgtgagtggggaatgaggctggtcctgcagcctctccctccgctcagggcttgaaggtcggtggcggagggggtggctctcacagggcccaactctaaagtggaagaaccttgttagaccgagagcttgccatccagccaagctgctcgaggccctgcagtggccttggcaatgtctgtgccacctcctgagccctcccagcatgtcctcacatgctcatgcccacccgctcctccacaagcctagtccatcctgcctgagctccagcccccagcccccactgtgcccagacatgtgtgctcagggtggctttctccctaggaccttctgtgtatatagttagttttataaccctgaatgcccccacccttcccctaagcacacaggggttaaagctgtgtgtccctcccagtggctgtggcagtgacagtgacacccacacccacagtaaagaggagactgaatgagaaaaaaaaaaaaaaaaaaaaaaaaaaaaaa

SEQ ID NO: 255 - DNA, 3568 bp, Homo sapiens
cccgcctccctaggcgtggaggagggggggcggctcagccccgcgcccgtgcgcgcgctcgcggccgggttgcagggctgggcgcgcgccccgcgtcccgggcaggaagatggtggcgagcgcgcgagtgcagaagctggtgcggcgctacaagctggcgattgccacggcgctggccatcctgctgctgcagggcctggtagtgtggagcttcagcggcctggaggaggacgaggcgggcgagaaaggaaggcagaggaagccacggccactggaccctggcgaaggttccaaggacacagacagttcagcagggcgacggggcagcacaggcagaaggcatgggcgctggcggggccgtgctgagagcccaggagtgcccgtggccaaggtggtacgggcagtaaccagccggcagagagccagccggcgggtcccacctgccccacctccggaagccccaggccgccagaacctgagtggggcagcagctggggaggcgctggtaggggcagctggcttcccaccacacggagatacagggagcgtggagggcgccccccagcccacggacaatggcttcacccccaagtgcgagatcgtgggcaaggacgcactgtctgcactggcccgggccagcaccaagcagtgccagcaggagatcgccaatgtggtgtgcctgcaccaggctgggagcctcatgcccaaggctgtgccccggcactgtcagctgactgggaagatgagccccggcatccagtgggatgagagccaagcccagcagcccatggatggccccccggtgcgaatcgcctacatgctggtggttcacggccgcgccatccgccagctgaagcgtctcctcaaggccgtttatcacgagcagcacttcttttacatccatgtggacaagcgttccgactacctgcaccgggaggtggtggagctggcccagggctatgataacgtgcgggtgacgccctggcgcatggttaccatctggggcggggccagcctcctgacgatgtacctgcggagcatgcgggacctgctagaggtgcctggctgggcctgggacttcttcatcaacctcagtgccactgactatccaaccaggaccaatgaggagctggtggcattcctatccaagaaccgggacaagaatttcctcaagtcacatggccgggacaactccaggttcatcaagaaacagggcctggaccggctcttccatgagtgcgactcacacatgtggcgcctgggcgagcggcagatcccagcaggcattgtggtggatggcggttctgactggttcgtgctgacacgcagctttgtggagtatgtggtgtacacagatgacccgcttgtggcccagctgcgccagttctacacatacacactgctcccagccgagtccttcttccacacggtgctggagaacagcctggcctgtgagaccctcgtggacaacaacctgcgggtcaccaactggaaccgcaagctgggctgcaagtgccagtacaagcacattgtggactggtgtggctgctcccccaacgacttcaagccacaggacttcctccggctgcagcaagtctccagacccaccttcttcgcccggaagttcgagtcgactgtgaaccaggaggtgctggaaatcctggacttccacctgtacggcagctacccccccggcacgccagccctcaaggcctactgggagaacacctacgacgcggctgatggccccagtgggctcagtgatgtcatgctcactgcttacacagccttcgcccgcctcagcctgcaccatgccgccactgctgcacccccaatgggcaccccactctgcaggtttgagcccaggggcttgccgtccagcgtgcacctgtatttctatgacgaccatttccagggctacctggtgacgcaggcggtgcagccctcagcccaggggccggcagagacgcttgagatgtggctgatgccccaagggtcgctgaagctgttggggcgcagtgaccaggccagccggctccagagtctggaggttggcactgattgggaccccaaagagcgtcttttccggaactttggggggttactggggccgctggacgagcctgtggccgtgcagcgctgggcccggggccccaacctcacagccacagtggtctggatcgacccaacctatgtggtggccacatcttatgacatcacagtagatacggagactgaggtcacgcaatacaagcccccactgagccggcccctgcggccagggccctggactgttcgactccttcagttctgggaaccgctgggtgagacccgcttccttgtgctgcccttgaccttcaaccgcaaactacctctcaggaaagatgatgccagctggctgcacgcagggccaccccacaacgagtacatggagcagagtttccagggcctgagtagcatcctgaacctgcctcagccggagctcgcggaggaggctgcccagcggcacacacagctcacaggccctgcgctcgaggcctggacagacagggaactgagcagcttctggtccgtggctggactgtgtgccataggcccctctccctgcccctccctggagccctgcagactgaccagctggagctctctgtcccccgaccccaaatcagagctggggcctgtcaaagcagacgggcgactcaggtagcagggccccagccagtacccgtggaggacccgggaaattgcaccttacagacagtggaggggtgtcccctcccacaggcaagaaccagaggcccaggctgcacacccatttcagccatcaagaacccacacagacggcagggaaggtggacacagtatgaactactgctgatgtctctgttggggatcagagggctggcgggaacgcgagaagggcaccagcagcattccacacccagctcttcctcaccttcctgtctagtttgaatttcttttttttctttcttttttttttttttttaatttaaaaaggaaaatgggtggttgggagagaaactagaacagaagatgtgcaatagggctcagagcagccccaggaagtgggccatgtctgtggggagcagtggcttgctgagcccacctgctattgttctgcacgaggctgggcctgcctcactctccagggcctcatgccccattctgggcctgtggtgctcgtggctgaggctccacagggctgcaagtgccctgccaggctctaaggcccgaagaacaggtgatatcgggggcgctgcagagctgggctctagcaggacagttcttttgtagccaggggaccctagaagtggggtggggcggctccagggctttccagcataccctgcccctggatgggaaaggcagggtcagggcccactgagacccatgcagagtttccaggtgtgcactggaagtgaggtcacatgagcagcgtgggaagaagactctgtcaagactctcagaagaacctggagtaattgtgcctgaagctcagcgtgaagtctgaaatatgcaacagaagaaatatatctctatctctcta

SEQ ID NO: 256 - DNA, 2863 bp, Homo sapiens
gtgcggccagcgggcggaggcggtctcgcatcggcggcgacggagggctcaggcgtcgtcgtttgggtggggggccgctgaactgacaagcgacatttcagctcctttcacccgccggaaccccggagccggggcccgctcagccggcgttaccatgaccaaggccggtagcaagggcgggaacctccgcgacaagctggacggcaacgaactggacctgagcctcagcgacctgaatgaggtcccggtgaaggagctggctgcccttccaaaggccaccatcctggatctgtcttgtaataaactgactactctaccgtcggatttctgtggcctcacacacctggtgaagctagacctgagtaagaacaagctgcagcagctgccagcagactttggccgtctggtcaacctccagcacctggatctcctcaacaacaagctggtcaccttgcctgtcagctttgctcagctcaagaacctgaagtggttggacctgaaggataaccccctggatcctgtcctggccaaggtggcaggtgactgcttggatgagaagcagtgtaagcagtgtgcaaacaaggtgttacagcacatgaaggccgtgcaggcagatcaggagcgggagaggcagcggcggctggaagtagaacgtgaggcagagaagaagcgtgaggctaagcagcgagctaaggaagctcaggagcgggaactgcggaagcgggagaaggcggaagagaaggagcgccggagaaaggagtatgatgccctcaaagcagccaagcgggagcaggagaagaaacctaagaaggaagcaaatcaggccccgaaatctaagtctggctcccgtccccgcaagccaccaccccggaagcacactcgttcctgggctgtgctgaagctgctgctgctgctgctgctatttggtgtggcgggagggctggttgcttgtcgggtgacagagctgcagcagcagcccctctgcaccagcgtgaacaccatctatgacaatgcggtccagggtctacgccgccatgagatcctccagtgggtcctccagaccgactctcagcagtgagcttgtccccagcacctgctgcctcccagccttggagtttggattcctatggaattgggttctgctggacacaacctctttttagcatcagacctacctgccatcatcaaatggctgcagattggtacatgagacctcctctttgtaggacttcttcattccttagtcagggttccctgaaggaatgaggagaaatgggaggtggcgggggggcgtggggggcagttacctgcatgcctaaaggagtaggcttgggggtggggagagagaaaacatagccttttctagttgttatataaagctgtgtaaaggcaaggctcgtttctactaaatggtcagctgtcactacatttatacttttgtatgccacaaaccctttcattcctccctgggaatcagggtagatcaggaggaactgggggggactagaacaccacgctcagtaaatccagtctaaactgggaggtaggggtattcctgttttctttaggacctcagagatgtaagcattttagcagccacacaaaatctctggctatgaaagggacttcatgaccatccagtccaatataacacttgcagacagagaaactgaggtcttccatgacttgcctagtctcccagctagtttgaggcaaaactggattcccactctggtattctttcttccctttacatcattttccctcctttataatgtcctgagagaccagaactcacaccagaatcgattattcctcaggtgaagcatagactctttcatggtagacagatttcacgactcagagatagaaatctcttgctatcatcaggtcacgggcagctcctgtggagtcctgcccaacttatgtggcttccataaaatggcaacagtccaggctccttgcctaattttagagcattaactccctaattgccagtaagcaaggaggtggatctctgcaaacctacactgtctatgacagctctagttgtacttggtgtgactaaatacctcaaaggcaacctgcttctgcaggttttgaagtgtcagcttcataagacactgaggtttagaattgtttgattctagaccataactgaagggcataaatggaaacaggatatgaagggaaacaagtagcatcatggagctgaaaagtggtgcatcacccaatggctagcacagacaaggatcacactgtccattctcttgtctgctaaattaagcattttcttgcctcctttgcttcatcttttcacaacagctggatagagggatcagaaatgactgtgtcatggtgctcattcactgcaaactcccagttgcaagctccttggctcccccggagggagcaagaatctcatagttcagagacacagagggccttttagccctaatgaccttttggatgggactgcaactcatgactatcctgatattagaagaaaggactttgttaatcttctcccccatagctctgctgcgtaggtctacatcttactcagaatcactacacattcctttagtcttcctccaagctccagagccattggtacaaatgctttattgaaactaaatacataatacacacaatgagatgaagacaatatagaagtccgcatagtcatcataatcccgttccttggccggttgaggcagctcagtggctgagcccagtcaagccaacccgcagcttcactcacgacttcaagatttgatgctaattcttttggatttctacagttattaaataagtgtctgagtggaaaaaaaaaaaaaaaaaaaaaaaaaaaaaaaaaaaa

SEQ ID NO: 257 - DNA, 2214 bp, Homo sapiens
ggcacgaggccgggacgcagggcaaagcgagccatggctgtctacgtcgggatgctgcgcctggggaggctgtgcgccgggagctcgggggtgctgggggcccgggccgccctctctcggagttggcaggaagccaggttgcagggtgtccgcttcctcagttccagagaggtggatcgcatggtctccacgcccatcggaggcctcagctacgttcaggggtgcaccaaaaagcatcttaacagcaagactgtggtccagtgcctggagaccacagcacagagggtcccagaacgagaggccttggtcgtcctccatgaagacgtcaggttgacctttgcccaactcaaggaggaggtggacaaagctgcttctggcctcctgagcattggcctctgcaaaggtgaccggctgggcatgtggggacctaactcctatgcatgggtgctcatgcagttggccaccgcccaggcgggcatcattctggtgtctgtgaacccagcctaccaggctatggaactggagtatgtcctcaagaaggtgggctgcaaggcccttgtgttccccaagcaattcaagacccagcaatactacaacgtcctgaagcagatctgtccagaagtggagaatgcccagccaggggccttgaagagtcagaggctcccagatctgaccacagtcatctcggtggatgcccctttgccggggaccctgctcctggatgaagtggtggcggctggcagcacacggcagcatctggaccagctccaatacaaccagcagttcctgtcctgccatgaccccatcaacatccagttcacctcggggacaacaggcagccccaagggggccaccctctcccactacaacattgtcaacaactccaacattttaggagagcgcctgaaactgcatgagaagacaccagagcagttgcggatgatcctgcccaaccccctgtaccattgcctgggttccgtggcaggcacaatgatgtgtctgatgtacggtgccaccctcatcctggcctctcccatcttcaatggcaagaaggcactggaggccatcagcagagagagaggcaccttcctgtatggtacccccacgatgttcgtggacattctgaaccagccagacttctccagttatgacatctcgaccatgtgtggaggtgtcattgctgggtcccctgcacctccagagttgatccgagccatcatcaacaagataaatatgaaggacctggtggttgcttatggaaccacagagaacagtcccgtgacattcgcgcacttccctgaggacactgtggagcagaaggcagaaagcgtgggcagaattatgcctcacacggaggcgcggatcatgaacatggaggcagggacgctggcaaagctgaacacgcccggggagctgtgcatccgagggtactgcgtcatgctgggctactggggtgagcctcagaagacagaggaagcagtggatcaggacaagtggtattggacaggagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatccaacctggctttatgcacctagatgtccccagcacccagttctgagccaggcacatcaaatgtcaaggaattgactgaacgaactaagagctcctggatgggtccgggaactcgcctgggcacaaggtgccaaaaggcaggcagcctgcccaggccctccctcctgtccatcccccacattcccctgtctgtccttgtgattggcataaagagcttctgttttctttggcaaaaaaaaaaaaaaaaaaaaaaaaaaaaaaaaaaaaaaaaaaaaaaaaa

SEQ ID NO: 258 - DNA, 2499 bp, Homo sapiens
gtgatccctgcgcgcgtctcctgctcgggtcagtgcgccgcgctgcgctgggcgccatggcgctccccggagcccgggctcgcggctgggcggcagcagccagagcggcccagaggcgccgccgcgtggagaacgcaggagggtccccgagtcctgagcctgcgggccggcgcgcggcgctttacgtacactggccttactgcgagaagcgctgcagttactgcaacttcaacaagtacatccctcgccgcctggaggaggctgccatgcagaagtgtctggtgaccgaagctcagacgctgctgcggctcagcggggtgcaacgggtggagtctgtgttctttggtggggggacccccagtctagccagtccccacacggtggctgctgtcctggaggctgtggcacaggcagcccacctgcctgcagacttggaagtcacattggaggctaatcctacttcagctccgggctccagactggcagagttcggggcagcaggggttaacaggttgtctataggcctccagtccctagatgacactgagctccggctgttgggacggacgcactcggcctgcgatgctctgcggacgctggcagaggcccggcgcctctttcccgggcgcgtgtctgtagacttgatgctggggctgccggcacagcaggtggggccgtggcttgggcagctgcaggaactgctgcaccactgtgatgaccacctctccctctaccagctgtccctggagcggggcaccgcactcttcgcccaggtgcagcggggtgcccttccagcccctgacccggagctcgcagctgagatgtaccagaggggccgggctgtccttcgggaggctggcttccaccagtatgaggtctccaactttgcccggaatggggcgctcagtacccacaattggacttactggcagtgtggtcagtaccttggcgttgggcctggggcccatggacgatttatgccccagggggctggaggccacacccgggaggctcggatccagacactggagcctgacaactggatgaaggaggtgatgctgtttggccatggcacccggaagcgtgtccccctgggcaggctggagctgctggaggaagttttggccctggggctacgcaccgatgtggggatcactcaccagcactggcagcagtttgagccccagctgaccctgtgggatgtgtttggagcgaacaaggaggtgcaggagctgctggagcggggcctactgcagctggatcacaggggtcttcggtgttcctgggagggtctggctgtgctggactctctcttgctgaccctcctgcctcagctccaagaagcctggcagcagagaaccccctcccctgtgccaggaggatgacaaaaatgttcctgtgttccagggtaatgccaggtgggttttgagagctgggtcggtactgcagacatctcttctccgttgtcgggtgccgtctctgctccttgtggttattgctcagccctggcatccccaggggaatggcagcagtgaggtagatgggaggacatttctggtcagggaactggcatcccattcagcatctcaggactcacaggccaacatgtgttccatggctgggaattgcctaccacccacatcagcttctgtttacctttttggcatcaaataatgaacagtgtttggaaatctttctacaggcaattacctccccaagagaagccttccttattttggagtaaggtcctaagatagctggatgaatcaggaaaaccatgtcccctctaggtattattaatattagcaggaagggatctactataggaatgaagtatttataaaccactgaaagggatagagaagtgaacattggagaaagccagtagcaactgtgagaaatcagcaacttgcaggaggcacagaaaactcctgctgatggtctcagcttccagcagcacaaaagcagatgatgtactggaaaatgctcagaagatgctacaaaacctcatgcctactgtctgccactgctggagaaggaatcatggtttctagaagtgcctctcattagtggactttaaagcaaatcctggctggcaggaaattctgaggaatatagctcttaggcttccagcctctaccatgcaggagagaacacagaaggactgatgtatgttggtggatccatgtatgtgtccagcacagcggcctgctggactctgagaactgggaaagatcagagcaagccttgcctcttatcttcgggaaaccagaatatgtttggggtggtaggagccacacagactcttctgagccccctcactcacttccttccccctgtgcctttcctttgagagtgaaggtgggtggagttgaccagagaaaggggagagaattcgggaaagacccaaagtgtttgtaattcttctttgtccttttacctacagaaatggtcacatggttctatttaaatagcctaataaacacatctggagcctgt

SEQ ID NO: 259 - DNA, 2943 bp, Homo sapiens
gtgctgcctggcgctggctaggaggcaaacgcacgcgggaagagctgctacccattccagggaccctgccgctgcccctctgaggggtctgcacctcctgggagcaggtgggtctctgggacgagggtccatggtggatggctctggagacgctcccgaggctgtgccgtcccgctgctgcacaggtcggagggtcaccgcagaggctactcgggctggggctggggccgagggagcccgcactggagccccatgtggaacccaaggatgcagctgctctgctaacacggcagcccatccttcgagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcaggagcgaacccacgccctcaagaccaaggagcgcatggcactggagggcatcggcattggcagtgggcagctgggcttcagccgccgctacggcgaggactacagccgctcccggggctccccgtcctcctacaactcctcctcttcgtcaccccgctatacctccgacctggagcaggcccggcctcagacgtcaggggaagaggaactgcagctgcagctggccctcgccatgagccgtgaggaggcagagaagcctgtccccccagcctcccacagggacgaggacctgcagctgcagctggctctgcgcctgagccggcaggagcacgagaaggaggtgaggtcctggcagggtgatggctcccccatggccaatggtgcaggggccgtggtccaccatcagcgggacagagagcctgagagagaggagagaaaggaggaggagaagctaaaaaccagccagtcctccatcctggacttggctgacatcttcgtacctgccctggccccgccctccacacactgctctgctgacccatgggacatcccaggttttaggccgaacacagaggccagtggatcctcctgggggccttctgcagacccctggtctccgatcccctcaggaaccgtcctgtcccgaagccagccctgggatctgactcccatgctctcctcctctgagccctggggcaggaccccagtgctgcctgctgggccccccaccacagacccctgggccctgaactctccccactacaaactccccagcactggggctgacccttggggagcctccctggagacctccgacacacctggtggtgcctcgacctttgacccatttgccaaacctccagaatccacagagaccaaggaggggctggagcaggccctgccctctgggaagcccagcagccctgtggagctggacctgtttggagaccccagccccagttccaagcaaaatggcacgaaggagccagatgccctggacctgggcatactaggggaagcactaacccagccaagcaaagaggcccgagcttgccggactcccgagtccttcctgggtccctcagcttcctccttggtcaaccttgactcgttggtcaaggcaccccaggttgcaaagacccggaaccccttcctgacaggtctcagcgctccgtcccccaccaacccgttcggcgcgggcgagacgggcaggccgacgctaaaccagatgcgcaccggctcgccggcgctgggcctggcaggcgggcctgtgggggcgcccctgggctccatgacctacagcgcctctctgcccctcccgctcagcagcgtgccagctggcttgaccctccccgcctcggttagcgtcttcccgcaggccggagccttcgcaccgcagccgctgctgcccacgccgagctcagccgggccgcggcccccgcccccgcagaccggcaccaaccccttcctctgagccccgccccgtcccataccggcctgcgcctgcgccggacgctccgcggccccgcctccggacccggggctgggcggggcgccggtgctagtggaacgccgtgccagtggcggctggtatcccgcggcggctctggaagctggacgcggaccacggcccgggagctagaaactgaacgcccgcataataaagactggaacccacgttctcagctctcaccaagtggactttttgcggggtgtggcggccgggtctcgaccacagcgtggatcaccggctgtttaggaaactgcagctgcacaacgtggggtgcaaaactgccccgcttcctttacagctcttctcaaccctcacctccatcccccgtcacccaggcaccttcgcttccagatgctgccaggctgtcactcaattcggtcatttcattcatttatcacacatgggcactggggttgggctaacagcaagagacaataggcctttgttcctatttattgggtactgcttacgtgctaagcagatcagtttatttaatgcttgcaacgactctctgaggtagaaaatattgttaattccgttcaggatcccggctacataatctgtggggctcaatacaaaataaaaatgtaggggctccttgttcaaaaaaaaaaaaaaaaa

SEQ ID NO: 260 - DNA, 2640 bp, Homo sapiens
gagcagccatgctgggcgcgcgggcctggttgggccgcgtccttctgctgccccgcgccggtgcaggcctcgccgcgagccgcaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaagctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaaaaaaaaaaaaaaaaaaaaaaaaaaaaaaaaaaa

SEQ ID NO: 261 - DNA, 2060 bp, Homo sapiens
ccggagccggccttcgggaggcgcggcccgggaggaggcctgggcctgcgggccgggagcagcaggggcggcccgcgggagggagcggaagtcccgggacgggcgcgggcagcggcgcgagcagggcgggcgagttccgcgctccctccccatggccgggagcgggccgcggcgacggcggcggcgctgacaggccccgggcggggcggggcaggcggcctggacgggggcctggggctgtgggaagatgaacgccctcctagagcagaaggagcagcaggagaggctgcgggaggccgcggccttaggggacattcgggaggtgcagaaactggtggagagcggggtggatgtgaactcccaaaatgaggtcaacggctggacttgtttacactgggcatgtaaacgaaaccatggtcaggtggtctcttacctgttaaaatcaggagctgacaaagaaattcttaccacaaaaggagaaatgccagtccagttaacatcaaggagagaaatcaggaagattatgggagtggaagaagaagatgatgatgatgatgatgatgacaacctcccccagctgaagaaggagtcagaactgccctttgttcccaactatttggccaacccagccttcccttttatctatacacccacagcagaggattcagcccagatgcagaatgggggcccctccacaccccctgcatcaccccctgcagatggctcacctccattgcttccccctggggaacctcccctgttagggacctttccccgggaccacacctctttggcactagttcagaatggtgatgtgtcggccccctctgccatactcagaacaccagaaagcacaaaaccgggtcctgtttgtcagccaccagtgagtcagagccgctccctgttttcttctgtcccgtccaagccaccaatgtctctggagcctcaaaatgggacgtatgcaggaccagcgccagcattccagccatttttcttcactggagcatttccatttaatatgcaagagctggtactcaaggtgagaattcagaacccatctcttcgagaaaatgatttcattgaaattgaactggaccgacaggagctcacctaccaagagttgctcagagtgtgttgctgtgagctgggtgttaatccagatcaagtggagaagatcagaaagttacccaatactctgttaaggaaggacaaggatgttgctcgactccaagatttccaggagctggaactggttctgatgataagtgaaaataattttctgttcagaaatgctgcatccacactgactgaaaggccttgctataacaggagagcttcaaaactgacttactaatgcagcagggacttttatcactgagtattatgacagtgtgcatcacctctgggccaaggacaagccattgatctaaatgcctcagatgcccgggagggcctctggtgccactgcatagtatatactaacatcattctgccaaggtaggaagcccctgacccccaagcagtggtgccactcttccaagcctcttggtgcacagtaaacctattgcttgaagctttgaacagctgagaagtggtctggagaggcagaagctgaaggttctatatccagtgtgttttatgtccagaatgtaagagagttgtctaagcagcagctgagagagagcggagcctatttctagccactcctgttgacagtgcacctgaagggctgggatgcgtttttcttggtgttgcatgctcacaactctgctgacattgggaacttatgagagaggaagactcgggaaagcacagatactggacagatggattctggtgtggggaaagcacagatactggacagatggattctagtgtgacttgtgactgtgaggtttcctataacatatttataaatgttactcaggttaaaagtatttaagaatacagttaactaattgtaaatatgctgttaaccaaaagagctttccctccctcactttttcctttgtaaacactcatgactgctaaaaaaaaaaaaaaaaaaaaaaaaaaaaaaa

SEQ ID NO: 262 - DNA, 3451 bp, Homo sapiens
  misc_feature 2141: n = A,T,C or G
tctggttcggcccacctctgaaggttccagaatcaatagtgaattcgtgggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgaaagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagncaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattgggcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttaaaaaaaaaaaaaaaaagctt

SEQ ID NO: 263 - DNA, 3451 bp, Homo sapiens; identical to SEQ ID NO: 262
  misc_feature 2141: n = A,T,C or G

SEQ ID NO: 264 - DNA, 4663 bp, Homo sapiens
gtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaacaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgaaaaaaaaaaaaaaaaa

SEQ ID NO: 265 - DNA, 2939 bp, Homo sapiens
agttaataggctggctgtcgcttggggttgctgcataaatgctaggagcagcagctctatggttatgaggtggggagaacggaatgacgtcatcgcttgggagctgctgcaggatggagtggaaagctgctgctgatggcattgtttttgtggcagcaagctgaatgacagatcctcactacaaagatacccctttggcccccgtgtaggcctccttggttcgggtgtttcaccatgccagcacagcgccatgagtcctggatgcatgctgctgtttgtgtttggctttgttggcggggcggtggtcattaattctgctatcttagtatctctctctgttttgctgcttgtgcacttttctatttctaccggtgtgccagctctgacgcagaacctaccaaggatactcagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttga

SEQ ID NO: 266 - DNA, 811 bp, Homo sapiens
gcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggattcattgagttggttacttcatattgttgcattgcttttttttccttct

SEQ ID NO: 267 - DNA, 1031 bp, Homo sapiens
gcagaagcgttccgtgcgtgcaagtgctgcgaaccacgtgggtcccgggcgcgtttcgggtgctggcggctgcagccggagttcaaacctaagcagctggaagggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggattcattgagttggttacttcatattgttgcattgcttttttttccttct

SEQ ID NO: 268 - DNA, 670 bp, Homo sapiens
cggccacgaggcggaatcccttctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgg

SEQ ID NO: 269 - DNA, 1873 bp, Homo sapiens
ccacgtgagcgcctgcgtttctcctcaaacctaacgatgccgccggagcggaggagacgaatgaaactggaccggagaaccggagcgaagcgaagcggaagcccggaatgaggccggactggaaagccggagcggggccaggcgggcctccccaaaagcctgccccttcatcccagcggaaaccgccggcccggccgagcgcggcggccgctgcgattgcagtcgcggcggcggaggaagagagacggctccggcagcggaaccgcctgaggctggaggaggacaaaccggccgtggagcggtgcttggaggagctggtcttcggcgacgtcgagaacgacgaggacgcgttgctgcggcgtctgcgaggcccgagggttcaagaacatgaagactcgggtgactcagaagtggagaatgaagcaaaaggtaattttccacctcaaaagaagccagtttgggtggatgaagaagatgaagatgaggaaatggttgacatgatgaacaatcggtttcggaaggatatgatgaaaaatgctagtgaaagtaaactttcgaaagacaaccttaaaaagagacttaaagaagaattccaacatgccatgggaggagtacctgcctgggcagagactactaagcggaaaacatcttcagatgatgaaagtgaagaggatgaagatgatttgttgcaaaggactgggaatttcatatccacatcaacttctcttccaagaggaatcttgaagatgaagaactgccagcatgcgaatgctgaacgtcctactgttgctcggatctcatctgtgcagttccatcccggtgcacagattgtgatggttgctggattagataatgctgtatcactatttcaggttgatgggaaaacaaatcctaaaattcagagcatctatttggaaaggtttccaatctttaaggcttgttttagtgctaatggggaagaagttttagccacgagtacccacagcaaggttctttatgtctatgacatgctggctggaaagttaattcctgtgcatcaagtgagaggtttgaaagagaagatagtgaggagctttgaagtctccccagatgggtccttcttgctcataaatggcattgctggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtggttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggttcatcttccttcctgtacagtattttcaaacttcccagtcattaaaaataagaatatttctcatgttcataccatggatttttctccgagaagtggatactttgccttggggaatgaaaaggcaaggccctgatgtataggttgcaccattactcagacttctaaagagactatttgaagtccagttgagtcacaagagaagcctgtcttgatatatcatctcagaaactttcctgaatatgtgataatatatggaaaatgatttatagatccagctgtgcttaagagccagtaatgtcttaataaacatgtggcagcttttgtttgaaaaaa

SEQ ID NO: 270 - DNA, 2717 bp, Homo sapiens
ttgacctctcgtccctgagaggcgggtgggtgttagttcagagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccagactactggacttggaggatcagcagttgcaggtcatgcctcagacaagattgaaaacatggtgcctgttaaagatcgaatcattaaaattagctttaatgcagatgtgcatgcaagtctccagtggaactttagacctcagcaaacagaaatatatgtggtgccaggagagactgcactggcgttttacagagctaagaatcctactgacaaaccagtaattggaatttctacatacaatattgttccatttgaagctggacagtatttcaataaaatacagtgcttctgttttgaagaacaaaggcttaatccccaagaggaagtagatatgccagtgtttttctacattgatcctgaatttgctgaagatccaagaatgattaaagttgatcttatcactctttcttacactttttttgaagcaaaggaagggcacaagttgccagttccaggatataattgaagtcagcaactaagtcttccttcaaagttgtgatttttgggaaaatcatatatcctatcttctcaaaggagaaatattgtacaataatatgaaggcttatattttaaataattattttttctcaactaatttttttcacttaaacttgagagaacaagttcagcttttatcataagaaactcatatgcctagctagaatatatgactgactattcaataccatactgaagagtttgatactattaaaataagccgctttgttttttaaatatgcaggcatgggttcagcttaattccataattcccttccagattattaactcttcatacttacagcaatgaatctgacaatgtttttcaaaaatgtatgctcagggttatttgtttcaagtcataggccagaacttctaaccatgtttattgtgtctaaaagagttggttgctattttccttcattatgaatagtcagtattttaaaagctcaaagtagaagaggagtcactaagccctaacagcttgtccaaagatttaaattcttatttcaaatttgatttgtcctttaaggtttagggctattttatattcagagttctgaataattactttgaaactgtagtatcataaaattgaaataaaatacatctactaggctgttagccaaagcatcaccattacaagtccatgaatgttaaaatgtacaggtgggattgtgaagatttactgacatcaaaagttcttctggaaacaaacctttgttaaaaaaaaaaagtattaaattgttttaatagtgatttatttgtcatcaaatgtacaacttattctaaatattttcattttctgtgttctaaatagaaatattaagttgcagtaaaaagagaaaaaaaggctatttagcattacaaagaatcatatttaaaggctgcccaatgtagagtctagtgacctgttcaggacacctgaaatataattaaatgacaattatcaaggttttaacaatttataattctaaaccagaggattataaagaagtgcaaattgacttttacattcaactttagttaaatgaaggcactcagtattcttcctgaataatacattcagtttctcacattttatgctttcatctattcagaattatttcatagtaaaataatctactcttatcacagctgtgtgacgatttctaaatgtaggaaggcctgtgaaacatgacactgcagttaaattggttggcctaaggactaagtaatttttcttctgctgaagttttaagtgagtatttgttccaaacaagttctgttgaaatctcacgctgttgtcaggaatcagtgttatcctggaactgttattctatttaatcttcattatagcagaaatgtgccaccatggctttgacatgttggtaggtattgtcttccaggcttcaaagctgcacagagtctacgttttagagagttggcacctttgatgtggtagtgagctgatcatccactttcttctaaaataaagagaagaaaatggccagtattcatcctgtccttctctttccccattccttgataactctcttgtctttactgggaagctggagagtcacagtctagtagaagaaagattagaaaaatttcaactgtaggtgcctttgcaacctatcctgggagaccctaaaacatatttagttttagtgcctagagattttcactcctctaacatctctggatacagtgtccctggtcaacatgaagaagttacagaagaacgctttctgatcctggcccctaaagaatttacttgtgctaagtaataaaattcctattgatcaaaaaaaaaaaaaaaaaa

SEQ ID NO: 271 - DNA, 4030 bp, Homo sapiens
ggtggggggccgcggagcgctggggagcagcggccgccggcgcggggaggggggtggggtgggacggcgcaccgcctccggtgctggcactaggggctggggtcggcgcggtgtcttctgcccttctgcagccgtcgacatttttttttctttctttttttcaattttgaacattttgcaaaacgaggggttcgaggcaggtgagagcatcctgcacgtcgccggggagcccgcgggcacttggcgcgctctcctgggaccgtctgcactggaaacccgaaagtttttttttaatatatatttttatgcagatgtatttataaagatataagtaatttttttcttcccttttctccaccgccttgagagcgagtacttttggcaaaggacggaggaaaagctcagcaacattttagggggcggttgtttctttctttcttatttctttttttaaggggaaaaaatttgagtgcatcgcgatggagaaaatgtcccgaccgctccccctgaatcccacctttatcccgcctccctacggcgtgctcaggtccctgctggagaacccgctgaagctcccccttcaccacgaagacgcatttagtaaagataaagacaaggaaaagaagctggatgatgagagtaacagcccgacggtcccccagtcggcattcctggggcctaccttatgggacaaaacccttccctatgacggagatactttccagttggaatacatggacctggaggagtttttgtcagaaaatggcattccccccagcccatctcagcatgaccacagccctcaccctcctgggctgcagccagcttcctcggctgccccctcggtcatggacctcagcagccgggcctctgcaccccttcaccctggcatcccatctccgaactgtatgcagagccccatcagaccaggtcagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctctggccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactaatccgcagctctagtcctttataagttgctttcctcttactttcagttttggtgataatcgtcttcaaattaaagtgctgtttagatttattagatcccatatttacttactgctatctactaagtttccttttaattctaccaaccccagataagtaagagtactattaatagaacacagagtgtgtttttgcactgtctgtacctaaagcaataatcctattgtacgctagagcatgctgcctgagtattactagtggacgtaggatattttccctacctaagaatttcactgtcttttaaaaaacaaaaagtaaagtaatgcatttgagcatggccagactattccctaggacaaggaagcagagggaaatgggaggtctaaggatgaggggttaatttatcagtacatgagccaaaaactgcgtcttggattagcctttgacattgatgtgttcggttttgttgttccccttccctcacaccctgcctcgcccccacttttctagttaactttttccatatccctcttgacattcaaaacagttacttaagattcagttttcccactttttggtaatatatatatttttgtgaattatactttgttgtttttaaaaagaaaatcagttgattaagttaataagttgatgttttctaaggccctttttcctagtggtgtcatttttgaatgcctcataaattaatgattctgaagcttatgtttcttattctctgtttgcttttgaacgtatgtgctcttataaagtggacttctgaaaaatgaatgtaaaagacactggtgtatctcagaaggggatggtgttgtcacaaactgtggttaatccaatcaatttaaatgtttactatagaccaaaaggagagattattaaatcgtttaatgtttatacagagtaattataggaagttcttttttgtacagtatttttcagatataaatactgacaatgtattttggaagacatatattatatatagaaaagaggagaggaaaactattccatgttttaaaattatatagcaaagatatatattcaccaatgttgtacagagaagaagtgcttgggggtttttgaagtctttaatattttaagccctatcactgacacatcagcatgttttctgctttaaattaaaattttatgacagtatcgaggcttgtgatgacgaatcctgctctaaaatacacaaggagctttcttgtttcttattaggcctcagaaagaagtcagttaacgtcacccaaaagcacaaaatggattttagtcaaatatttattggatgatacagtgttttttaggaaaagcatctgccacaaaaatgttcacttcgaaattctgagttcctggaatggcacgttgctgccagtgccccagacagttcttttctaccctgcgggcccgcacgttttatgaggttgatatcggtgctatgtgtttggtttataatttgatagatgtttgactttaaagatgattgttcttttgtttcattaagttgtaaaatgtcaagaaattctgctgttacgacaaagaaacattttatgctagattaaaatatcctttcatcaatgggattttctagtttcctgccttcagagtatctaatcctttaatgatctggtggtctcctcgtcaatccatcagcaatgcttctctcatagtgtcatagacttgggaaacccaaccagtaggatatttctacaaggtgttcattttgtcacaagctgtagataacagcaagagatgggggtgtattggaattgcaatacattgttcaggtgaataataaaatcaaaaacttttgcaatcttaagcagagataaataaaagatagcaatatgagacacaggtggacgtagagttggcctttttacaggcaaagaggcgaattgtagaattgttagatggcaatagtcattaaaaacatagaaaaatgatgtctttaagtggagaattgtggaaggattgtaacatggaccatccaaatttatggccgtatcaaatggtagctgaaaaaactatatttgagcactggtctctcttggaattagatgttatatcaaatgagcatctcaaatgttttctgcagaaaaaaataaaaagattctaacaaaaaaaaaaaaaaaa

SEQ ID NO: 272 - DNA, 1932 bp, Homo sapiens
ccggactgcggaaggatggagctggccgccggaagcttctcggaggagcagttctgggaggcctgcgccgagctccagcagcccgctctggccggggccgactggcagctcctagtggagacctcgggcatcagcatctaccggctgctggacaagaagactggacttcatgagtataaagtctttggtgttctggaggactgctcaccaactctactggcagacatctatatggactcagattacagaaaacaatgggaccagtatgttaaagaactctatgaacaagaatgcaacggagagactgtggtctactgggaagtgaagtacccttttcccatgtccaacagagactatgtctaccttcggcagcggcgagacctggacatggaagggaggaagatccatgtgatcctggcccggagcacctccatgcctcagcttggcgagaggtctggggtgatccgggtgaagcaatacaagcagagcctggcgattgagagtgacggcaagaaggggagcaaagttttcatgtattacttcgataacccgggtggccaaattccgtcctggctcattaactgggccgccaagaatggagttcctaacttcttgaaagacatggcaagagcctgtcagaactacctcaagaaaacctaagaaagagaactgggaacattgcatccatgggttgatgtctctggaagtgcaaccacccaatgtctctggaagtgccacctggaagtgccacctggaagtgtctctggaagagcacccaccactgttcagccttcccctgctgtttctgtcttcagaggcctacacactaccacatcctttctaagcatgtttgcctgacatccagctcactcgtctgcttcctttctcgctccccccatcctgggctgggctgccttcttctacagttcaatatggggcagactagggaaacctttgcttgcttactattaggaggggaagtcttcagtagggaacacgatcattccattgtgcaattttacggggatgggtgggcggagggacacaacaaaatttaagaatgactatttgggcgggctggctcttttgcagcttgtgatttcttccagcttgggaggggctgctggaagtggcatttcgttcagagctgactttcagtgcacccaaactggatgacgtgccaatgtccatttgccttatgctttgtggagctgattaggctgggatttgaggtgataatccagtaagtctttcctcgttcctacttgtggaggatcagtagctgttatgatgccagaccatttggagaagtatcagaggcctgaccggacacataatacgacaaccacatttttcctcatcatccatgaggaaatggatgatttctcttttccatatgtcactgggggaaaggctgcctgtacctctcaagctttgcattttactggaaactgaggcgtcaagatggctgtggcagctagcaaaagcaaagatgctttgtgcatagccttgtgaaaaagtatctttctatgcaataagatgaattttcctcccagaatatttagaaatgtagaagggataacagttcacagccaggtaaaatttaactggtggcttaatgactctgcacctttttctcaggaattctgcctaagttgtctgccttttctaccaccaaaaagacttttagttttctatgctttctcctgaattttggtagggtaagtatttctatgtcaaaggcacagccttgatgatctcagggaaaaattttaatcactgtgtataatgatactgaaccttgattaataacagaaattcaggatgtaaagccacagaatgggatttattaatgtgggatacctcagactgtttgttttctttctgggaagaaaagtgtgttctataatgaataaatatagagtggttttt

SEQ ID NO: 273 - DNA, 5002 bp, Homo sapiens
aggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatgaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcttggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacattgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatgatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgctagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctcgggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggcagccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagagggggcctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaaggaaaaaaaaaaaaaaaa

SEQ ID NO: 274 - DNA, 5005 bp, Homo sapiens
gggaggggcgggatttcctgcgggaggcgccgagccggccttggaaaaggagaaggagaaaggggggcaggggggagtgggagccaccgtcctgagtgccagggaccgagcagggccagccggaccccggcgggcggccgggagagagccctgagaccagtgcaccgctgctgcctgaggcccaagggaatgctggctgctctctgggtgggcactggtgttccacagccaagccgggaagattggtgtgcccagtcccagcccatcctggagctgtcggaagccacaagctgatatccatccagatttccatgtagccttcaccccctcaaagattagctttccttcgtgtggtggcagttcacggagcacctttgggagtatccctcagtacctgacgaggagcccactgcctgggacaccagacttgctcccccggaaccgggagccctccaaggggctgtggcatggcgccctgacgccccagcttggacccgttgcctgcctttgccctggactcctgagtgtagagctcagcccaggagccagtatgggtcgtgaacaggacctgatcctcgccgtcaagaatggagatgtgaccggtgtgcagaaactggtggcgaaggtcaaggccacaaagacaaagctcctgggctccacaaagaggctcaacgtgaactaccaggatgctgatggattctctgccctccaccacgctgctttggggggcagcctggagctcatagccttgctgctagaggctcaggccactgttgacatcaaggacagcaatggcatgcgcccgctgcactacgcagcctggcagggccggctggagcctgtgaggctgctgctgcgcgcctctgcggctgtcaatgccgcctcgctggacggacagatccccctgcacctggctgcacagtatggacattatgaggtgtcagaaatgctcctccagcatcagtccaacccatgcctggtcaacaaggccaagaagacgcccctggacctggcctgtgaatttggccgactcaaggtggcccagctgcttctgaacagccacttatgtgtggcactgctggagggtgaggccaaagacccgtgtgaccccaactacaccacgcccctgcacttggctgccaagaatggccacagagaagtcatcaggcagctcctgagagctgggatcgagatcaaccgccagaccaagacgggtacggcgctccacgaggccgcactgtatggcaagaccgaggtggtgcggctgcttctggagggaggtgtggacgtgaacatccggaatacgtataaccagacggcgctggacatagtgaatcagttcaccacctcccaggccagccgggaaatcaagcagctactgcgggaggcctcagggatcctgaaggtccgagcgctcaaggatttctggaacctccacgatcccactgctctcaatgtccgggcaggggatgtcatcacggtgctagaacagcatcccgacggccgctggaagggccacatccacgagagccagaggggcacagaccgcataggctacttccccccgggcattgtcgaggtggtcagcaagcgggtgggcatccctgcagcccgcctcccctccgcacccacccccctgcgcccaggcttctcccggacaccgcagcctcctgccgaagaacccccgcaccctcttacctacagccagcttcctcgggtgggcctcagcccagacagcccagcaggtgacaggaatagtgtgggcagtgagggcagcgtgggcagcatccgcagtgccggcagcgggcagagctctgagggcactaatggccatggccctggcctcctgattgagaacgcccagccactgccctctgctggagaggaccaggtgctgccaggactccacccgccgtccctggcagacaacctgagccaccgccctctggccaactgccgctctggggagcagatcttcacccaggacgtgcggccagaacagctgctggaggggaaggacgcgcaggccattcataactggctaagcgagttccagctggagggctacactgcccactttctgcaggccggctatgatgtgcctaccatcagccgcatgacacctgaggacctgacggccatcggggtgaccaagcctgggcacaggaagaagatcgcctcagagatcgctcagctcagcatcgccgagtggctgcccagctacatcccaacggacctgctggagtggctgtgtgcactggggctgccacagtaccacaagcagctggtgagcagcggctacgactccatggggctggtggccgacctcacctgggaggagctgcaggagattggggtcaacaagctcgggcatcagaagaagctcatgctgggggtgaagcggctggcggagcttcggcggggcctgctgcagggggaggccctcagcgaaggcgggcgccggctggccaagggtccggagctgatggccatcgagggactggagaacggagaaggcccagctacagctggcccacggctcctcaccttccagggcagcgaactaagcccagagctacaggcggccatggcagggggtggccctgaaccactccccctcccacctgcccgctctcccagccaggagagcatcggggcacgctcacgggggtctggccactcacaggaacagcctgccccacagcccagcggtggagatcccagccccccccaggagaggaacctcccagagggcacagagcggccccctaagctttgttcttcacttcctggccaaggacccccaccctatgtttttatgtacccccagggctcaccctctagcccggccccagggccacctcctggcgcaccctgggccttctcctacttggccgggccccctgccactcccccagacccgcctcgacctaagcgccggtcccacagcctaagccgccctggccccacagagggggatgctgagggggaggccgaagggccagtgggcagcaccctaggcagttatgctacccttacccggcggccaggacgcagtgcccttgtccggaccagtcctagcgtgaccccaaccccagctcgggggactcctcgcagccagtcctttgccctgcgggcccggcgcaaaggccccccgcccccgccccccaagcgcctcagctccgtctctggccccagcccggagccacctccactagatgggagcccagggcccaaggaaggggccacagggccccgaaggcgaacactgagtgaacctgctggcccctcagagccccctggcccacctgccccggctgggcccgcgtcagacacggaggaggaggagccaggccctgaggggacgcccccatctcggggcagctctggggaagggctgccgtttgcagaggaagggaacctgaccatcaaacagcgcccgaagcccgctggccccccgccccgagagacacccgtgccccccggcctcgatttcaacctcacggaatcagacactgttaagcggaggcccaagtgccgggagagagagccactgcagaccgcactgctggccttcggagtggccagtgccacgcctggccccgctgccccactgccttccccaactcctggcgagtctcctccagcttctagccttccccagcccgagcccagcagccttccagcccaaggagttccaaccccccttgctcccagccccgccatgcagcctccagtgccgccctgcccagggccaggtctggaaagctcagcagctagtcggtggaatggggagacagaacccccggccgcccctgctgccctcctcaaggtgcccggagcaggaacagcccccaagcctgtgtcggtggcctgcacccagctggcattttctggccctaagctagcgccccggctcggcccccgcccagtgcctcctccacggcctgagagcactgggactgtgggcccaggccaggcccagcagagactggagcagaccagctcgtccctggcagctgcactgagagccgcagagaagagcattggcaccaaggagcaagagggcacccccagcgcctccaccaagcacattctggatgacatcagcaccatgttcgacgccctggctgaccagctggacgccatgctggactgagccctccagcagtgcccactgtgacctgccgaagtccactgcctttgccccagcacagaagaggcccctgccaccctagggacgggccaagggctggtcaggctgaagtgcccctcctagcagggccccttcccactcagcccgcggctgtgggcaccacagctcttgtggggcagcccaccttagaacctgactagcgagggacctccgctgcatctcagcaaagcccctcccagggtttgatcgattgagcaggacagccctgctcctggacagggaccctggtaagagctctctcctcagggaggaagtaggggtggggctttgggggtgctttctctgtaccccccagcccatgtcccaagttgtgccaagggaatgcctcttgccacccaccatcctgcccaggccctgagaggctggaggaggcgtgtgtctggccgggccccctctccgtaggtgtacagaggacatgtaaatacacagcggtggtgcccaggcagctcctgcccccgccttccctcactgaggcagggctagcaggggtgggaggcagtggggttaacagatcccacaagtcctaacttttcaattgtaaatgttattttctaagcagagagaaatgcatatattttaaatggaatttattctatcaactgcctgagaggacacaatgggggaggggcttcggaccacagcaggagccccgactgcccacctgagggcagggagagcctgaccccattggcccaggccctggctctgtaaccattaacctcttcccccaactaacaccaatgaaaacaccattccacgtgaaaaaaaaaaaaaaaaaaaaaaaaaaaa

SEQ ID NO: 275 - DNA, 5005 bp, Homo sapiens; identical to SEQ ID NO: 274

SEQ ID NO: 276 - DNA, 3497 bp, Homo sapiens
cggacgcggccgccgccgtcgccgccatctgtcacctccactccggcatcagcagccagtcgcccgtgtcccgcctgtctcctcggcggagcctgctgcccgtcctgccacctctctgctctgttcttgtctctgccttcattcccgaatggatctggtaggagtggcatcgcctgagcccgggacggcagcggcctggggacccagcaagtgtccatgggctattcctcaaaatacaatatcttgttctttggctgatgtaatgagtgaacagctggccaaagaattgcagttagaagaagaagctgccgtttttcctgaagttgctgttgctgaaggaccatttattactggagaaaacattgatacttccagtgaccttatgctggctcagatgctacagatggaatatgacagagaatatgatgcacagcttaggcgtgaagaaaaaaaattcaatggagatagcaaagtttccatttcctttgaaaattatcgaaaagtgcatccttatgaagacagcgatagctctgaagatgaggttgactggcaggatactcgtgatgatccctacagaccagcaaaaccggttcccactcctaaaaagggctttattggaaaaggaaaagatatcaccaccaaacatgatgaagtagtatgtgggagaaagaacacagcaagaatggaaaattttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagaaaaagcagttgatcctaagacacgtttacttatgtataaaatggtcaactctggaatgttggagacaatcactggctgtattagtacaggaaaggagtctgttgtctttcatgcatatggagggagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatcatccgcatgtgggcagaaaaagaaatgcacaatctcgcaagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtctggttgatcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacaacatacttgctttattcacctccctgttttgtgttgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacgtattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgccactgcactccggcctaggtgacagagggaaactccatctccaggaaaaaaaaaaaaaaacccaatttggataccaaattaatcaactaatttgagctatctggccttactcttagtagtttttagtacgtgctggacaccacttttaaaaagcaatcactgtgctagaaaagtatattggctttgttaggattaaagttcattaacttcaatgtaatcatgcctcctattactgaagtcagattggaaccactaaagatccaaactttctgtctggtaatagaaagtaaaaatctagacatcatttacatttgagaagctgtttttaacattattttaaaatgccaaatatgttctttctagaaaaatatttatttttgtttttgttggatagcttttaattacatttcagagaggtgtaattttgggtagatgctcattacatttttgaaaggtttatgattccaaaataaagatttatatgactggtgatactggctttacagaaatttcagagaactaatttttaaaatctttagcatttaaaactttttttgttttgttttctgacatattctgacaaagagcagcaaaccactg

SEQ ID NO: 277 - DNA, 3589 bp, Homo sapiens
cggacgcggccgccgccgtcgccgccatctgtcacctccactccggcatcagcagccagtcgcccgtgtcccgcctgtctcctcggcggagcctgctgcccgtcctgccacctctctgctctgttcttgtctctgccttcattcccgaatggatctggtaggagtggcatcgcctgagcccgggacggcagcggcctggggacccagcaagtgtccatgggctattcctcaaaatacaatatcttgttctttggctgatgtaatgagtgaacagctggccaaagaattgcagttagaagaagaagctgccgtttttcctgaagttgctgttgctgaaggaccatttattactggagaaaacattgatacttccagtgaccttatgctggctcagatgctacagatggaatatgacagagaatatgatgcacagcttaggcgtgaagaaaaaaaattcaatggagatagcaaagtttccatttcctttgaaaattatcgaaaagtgcatccttatgaagacagcgatagctctgaagatgaggttgactggcaggatactcgtgatgatccctacagaccagcaaaaccggttcccactcctaaaaagggctttattggaaaaggaaaagatatcaccaccaaacatgatgaagtagtatgtgggagaaagaacacagcaagaatggaaaattttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagaaaaagcagttgatcctaagacacgtttacttatgtataaaatggtcaactctggaatgttggagacaatcactggctgtattagtacaggaaaggagtctgttgtctttcatgcatatggagggagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatcatccgcatgtgggcagaaaaagaaatgcacaatctcgcaagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtgaggagcacattttgttaacattcagatttaattactgtaagtaaaatttaaaatgtaaatacatcagttcatgttctgtattgaaataggtctggttgatcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacaacatacttgctttattcacctccctgttttgtgttgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacgtattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgccactgcactccggcctaggtgacagagggaaactccatctccaggaaaaaaaaaaaaaaacccaatttggataccaaattaatcaactaatttgagctatctggccttactcttagtagtttttagtacgtgctggacaccacttttaaaaagcaatcactgtgctagaaaagtatattggctttgttaggattaaagttcattaacttcaatgtaatcatgcctcctattactgaagtcagattggaaccactaaagatccaaactttctgtctggtaatagaaagtaaaaatctagacatcatttacatttgagaagctgtttttaacattattttaaaatgccaaatatgttctttctagaaaaatatttatttttgtttttgttggatagcttttaattacatttcagagaggtgtaattttgggtagatgctcattacatttttgaaaggtttatgattccaaaataaagatttatatgactggtgatactggctttacagaaatttcagagaactaatttttaaaatctttagcatttaaaactttttttgttttgttttctgacatattctgacaaagagcagcaaaccactg

SEQ ID NO: 278 - DNA, 3497 bp, Homo sapiens; identical to SEQ ID NO: 276

SEQ ID NO: 279 - DNA, 3589 bp, Homo sapiens; identical to SEQ ID NO: 277

SEQ ID NO: 280 - DNA, 2158 bp, Homo sapiens
ccagagccgcagccgcagccgccgctacagtccgggccgggctccaccgcgcatcctgctccactctggcgaccgcccccggggtccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagcgcgccgtgatcttgctgtctaccacggtcctggagaatgtcctgcagccttttcactttagggctggcactatgtcgaagctgcccaagtttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcctgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactat

SEQ ID NO: 281 - DNA, 4673 bp, Homo sapiens
tttgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtcctctcctttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaaaaaaaaaa

SEQ ID NO: 282 - DNA, 2333 bp, Homo sapiens
tgcggagcttcgtgatgcacgccccgatgcctgcggggctataaaaacgctcgcaagcgccaagtctcctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttaggtaaagtttcatctattcattctgatcaatctgatgtgttaatggtggatgtggcaaccagtatgcctgttgttatcaaggaggtgccaagctcagaggctgctgaagatgtcatggtggctgctcctcttgtgtgttctggaaaggtgctagaagtgcaggttgtgaaccaaacatctgtccatgtagatttgggttctcaacctaaagaaaatgaggctgaaccatcaacggcttcctcagtccccttgcaggatgaacaagaacctcctgcttatgatcaagctcctgaggtcactttgcaggctgatattgaggttatgtcaactgttcatatatcatctgtctataacgatgtgcctgtgactgaaggagttgtttatatcgagcaactgccagaacaaatagttatcccttttactgatcaagttgcttgtcttaaagaaaatgagcagtcaaaagaaaatgagcagtcaccacgagttagtcccaaatctgtagtagaaaagaccacctctggcatgtctaaaaaatctgtagagtctgtaaaacttgcacagttggaggagaatgcaaaatattcctcagtatatatggaggcagaagcaacagctctgctctctgacacatctttgaaaggtcagcctgaggtacctgcacaactcctggatgcagaaggtgctatcaaaataggctctgaaaaatctctgcaccttgaagtggagatcacttcaatagtctctgacaatactgggcaggaggagtctggggaaaactctgtaccccaggagatggaaggcaaacctgtgctctctggggaagctgcagaagcagtgcactcaggtacatctgtaaagtcatctagtggccccttccctcctgctccagaaggccttactgcaccagaaattgaaccagaaggggaatcaacagctgaataaggtttgatgaagccagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcctggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcata

SEQ ID NO: 283 - DNA, 1153 bp, Homo sapiens
tgcggagcttcgtgatgcacgccccgatgcctgcggggctataaaaacgctcgcaagcgccaagtctcctcaggagccgccggcaagggggcaacgaggaagctcttaagagcgcggccggaaagcagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcctggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcata

SEQ ID NO: 284 - DNA, 1284 bp, Homo sapiens
cctatggctccgaagtccccgctggcatcctgaaagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcctggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcata

SEQ ID NO: 285 - DNA, 2279 bp, Homo sapiens
tgcggagcttcgtgatgcacgccccgatgcctgcggggctataaaaacgctcgcaagcgccaagtctcctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttaggtaaagtttcatctattcattctgatcaatctgatgtgttaatggtggatgtggcaaccagtatgcctgttgttatcaaggaggtgccaagctcagaggctgctgaagatgtcatggtggctgctcctcttgtgtgttctggaaaggtgctagaagtgcaggttgtgaaccaaacatctgtccatgtagatttgggttctcaacctaaagaaaatgaggctgaaccatcaacggcttcctcagtccccttgcaggatgaacaagaacctcctgcttatgatcaagctcctgaggtcactttgcaggctgatattgaggttatgtcaactgttcatatatcatctgtctataacgatgtgcctgtgactgaaggagttgtttatatcgagcaactgccagaacaaatagttatcccttttactgatcaagttgcttgtcttaaagaaaatgagcagtcaaaagaaaatgagcagtcaccacgagttagtcccaaatctgtagtagaaaagaccacctctggcatgtctaaaaaatctgtagagtctgtaaaacttgcacagttggaggagaatgcaaaatattcctcagtatatatggaggcagaagcaacagctctgctctctgacacatctttgaaaggtcagcctgaggtacctgcacaactcctggatgcagaaggtgctatcaaaataggctctgaaaaatctctgcaccttgaagtggagatcacttcaatagtctctgacaatactgggcaggaggagtctggggaaaactctgtaccccaggagatggaaggcaaacctgtgctctctggggaagctgcagaagcagtgcactcaggtacatctgtaaagtcatctagtggccccttccctcctgctccagaaggccttactgcaccagaaattgaaccagaaggggaatcaacagctgaataaggtttgatgaagccagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcctggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcata

SEQ ID NO: 286 - DNA, 1390 bp, Homo sapiens
tgcggagcttcgtgatgcacgccccgatgcctgcggggctataaaaacgctcgcaagcgccaagtctcctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcctggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcataaaaaaaaaaaaaaa

SEQ ID NO: 287 - DNA, 902 bp, Homo sapiens
tgcggagcttcgtgatgcacgccccgatgcctgcggggctataaaaacgctcgcaagcgccaagtctcctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcata

SEQ ID NO: 288 - DNA, 3336 bp, Homo sapiens
ccagggccggtgtctccaggagagggccgagcgcacagcagctctaggacctcgcaggcgcctcggcgcggcactcacgtagagcccaaggagcagtccccgacctctcctcggagggccgtgcaggcttccccggcggtccctacctgcgcctccgcccgccagcggcgctggggaaggggaggagcggcccggacgctgcccgccgcgcgcagggagccgcccgccgcaggccttgccgccgcccgcccgcgctctccccgcgagccccggagggcgggtctgcggccgagccagcggcggcggaggggcagcgcagacctctgcggcccgggcgggcgcggcgcgggagtcctgggccgctggcgggcaacgcctctgcccgacctcgctggggaaggctggcgctgctgcccggccggagccaggggcaggctgcgcaaaggtgacttagggagaccttgcgggccgccctgggtcgcgcctcccggatcggctcgcctcggctcgactggaggggaggaggaggagcaggccgagcgcattcgcgctggagcttgcgaggagcgcagggtggagcgcgccagccggggtcctcggatctggcccaggtgaggaattttaaattggaacaagagcaagaaaaaaacaaaatcttgtcagaagcactggagacgctggccactgaacatcatgaattagagcagtctctggtgaaaggctctccacccgccagcatccttagcgaggacgagttctatgatgcgctgtcagattccgagtccgaaaggtccctgagtagattggaagcagtgacagcacgctcctttgaagaggaaggagagcatttgggcagtagaaaacacagaatgtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacaggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtatggcaatgtggaaattataaaccacaagactggggacaaatgtgtgttgaattttaagccatgtggcctttttggtaaggaattacacaaagttgaaggctacattcaagataaaagcaaaaagaagctctgtgccctctatgggaagtggactgaatgtttatacagtgttgaccctgccacgtttgacgcttacaaaaaaaatgataagaaaaatacagaagagaagaagaacagcaaacagatgagcacctctgaggagttggatgaaatgccagtgccggattctgaaagtgtattcattatccctggaagcgttcttctatggcgaatagccccacggcctccaaattctgcccagatgtataattttactagttttgcaatggttttgaatgaagtagacaaagacatggagagtgtgattcccaagacagactgcaggttacggcctgacatcagagccatggaaaatggagagatagatcaagctagtgaagaaaaaaaacgacttgaggaaaaacaaagagcagcccgcaaaaacaggtccaagtcagaagaggactggaagacgaggtggttccatcaaggtcctaatccctacaatggagcacaggactggatttactctggcagctactgggacagaaattacttcaatttgcctgacatttattaaaatgcatacaagtcagggtgtttggctaatctacaaataagtcttaaacctatgtttttaaatttttttcccttggtttctacttatcttttaaaaaaaaaatgaaaaaacactcatgagataactgcatttcacccaacaaaagcagggtataaggcgatattggtgatgaaagtcttaggaaaaatgcataattttgctataaaatgtacttatttggaatactattttatatagaggtaagagaacactgctggggaatatgctttttatggttgctgttgccatatttactgaaggtttatacctaaatgtaactttagctttatggaactatatagtaatcccaaatcaagttattttgaatatttttatgctgtcatgcttgaatgttttagatgtaacctttgacatatttagaactctcctcctatacaatgtttattctcagatatagaggttatgtcattttataaagacttcattgataagatggcttttattcatactaatcctcccaatgttaccccttccatcttccaagaagaaaaaaaatgcctgaatattcagaatagatatttctgatttgaaaattctaaagaattaaactggaaaagtatttcatttacttagtgctctgaatttacttttacagttttctgcagtcagtatcattaaaatggttaagtttacatttgaactgaaaatatgtataaaatctagcaattcacaaaaatgccctagaaatatagattttaatcaccattacataatgacaaaccttgttaaatgcttccacttccagtggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctcccaggggcctaggtagctgccagtccgtgattttaattgctgtcttgaagttaacaagtgttataatgaaataatctacctgatgctaaataaaggctttagaatgttccccaaaaaaaaaaaaaaaaaaaaaaaa

SEQ ID NO: 289 - DNA, 4165 bp, Homo sapiens
ccgtggtcccggcgccgggtcccggagacagacgttacgcgggctcgagcgtcctcggggagtgccagccagagttggtgacgaccacttcctcgacgtggggcgggcggacgggaagcctggggtcgtggccaccgcctcgggagctctgggagcccgggtgaccgcgtagaaatgaacacagaagcggagcaacagcttctccatcacgccagaaatggcaatgctgaagaagtaagacaactattagagaccatggcgaggaatgaagtgattgctgacattaattgcaaaggaagaagtaagtctaacttgggctggacacctctacatctggcatgctattttggacacagacaagtggtccaggatctgttgaaggctggtgcagaagtgaatgtgttgaatgacatgggagacacgccgcttcatcgagctgcctttacaggacgaaaggagttggtaatgcttctcttagaatataatgctgatactactattgttaatgggagtggacagacagcaaaagaagttactcatgctgaagaaatcagaagcatgcttgaagctgtagaaaggactcaacaaagaaagcttgaagaattacttttagcagcagcaagagaaggcaaaacaacagaactcacagctctgctcaacaggcccaatcctcctgatgttaactgttcggatcagttaggaaatacacccttgcattgtgcagcttaccgggcccataaacaatgtgccttaaagcttctaagaagtggagcagaccctaatctgaagaacaaaaatgatcagaaacctcttgaccttgcccagggtgctgaaatgaaacacattcttgttggtaataaggtcatctacaaagcattgaaacgatatgagggccctctctggaagagttcaagattttttggctggagattattctgggtagtgttagagcatggagtcctttcatggtataggaaacagcctgatgcagttcataatatttatcgccagggatgcaaacacctgactcaagcagtatgcacggtaaaatccactgatagctgcctcttctttattaaatgctttgatgacaccattcatggcttccgggttcctaagaatagccttcagcagtcaagagaggactggctggaagcaatagaagaacattctgcttacagcactcactactgttcccaggaccagctgactgatgaggaggaggaagatacggtttctgctgcagacctgaagaaatcattagagaaagcacagtcatgccaacagcgactagatagggaaatttccaactttctcaaaatgattaaggagtgtgacatggctaaagaaatgcttccatcatttcttcagaaagttgaagttgtctcagaagcttctagagaaacttgtgtagctttgactgattgccttaatctcttcaccaaacaagaaggggtgaggaattttaaattggaacaagagcaagaaaaaaacaaaatcttgtcagaagcactggagacgctggccactgaacatcatgaattagagcagtctctggtgaaaggctctccacccgccagcatccttagcgaggacgagttctatgatgcgctgtcagattccgagtccgaaaggtccctgagtagattggaagcagtgacagcacgctcctttgaagaggaaggagagcatttgggcagtagaaaacacagaatgtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacaggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtatggcaatgtggaaattataaaccacaagactggggacaaatgtgtgttgaattttaagccatgtggcctttttggtaaggaattacacaaagttgaaggctacattcaagataaaagcaaaaagaagctctgtgccctctatgggaagtggactgaatgtttatacagtgttgaccctgccacgtttgacgcttacaaaaaaaatgataagaaaaatacagaagagaagaagaacagcaaacagatgagcacctctgaggagttggatgaaatgccagtgccggattctgaaagtgtattcattatccctggaagcgttcttctatggcgaatagccccacggcctccaaattctgcccagatgtataattttactagttttgcaatggttttgaatgaagtagacaaagacatggagagtgtgattcccaagacagactgcaggttacggcctgacatcagagccatggaaaatggagagatagatcaagctagtgaagaaaaaaaacgacttgaggaaaaacaaagagcagcccgcaaaaacaggtccaagtcagaagaggactggaagacgaggtggttccatcaaggtcctaatccctacaatggagcacaggactggatttactctggcagctactgggacagaaattacttcaatttgcctgacatttattaaaatgcatacaagtcagggtgtttggctaatctacaaataagtcttaaacctatgtttttaaatttttttcccttggtttctacttatcttttaaaaaaaaaatgaaaaaacactcatgagataactgcatttcacccaacaaaagcagggtataaggcgatattggtgatgaaagtcttaggaaaaatgcataattttgctataaaatgtacttatttggaatactattttatatagaggtaagagaacactgctggggaatatgctttttatggttgctgttgccatatttactgaaggtttatacctaaatgtaactttagctttatggaactatatagtaatcccaaatcaagttattttgaatatttttatgctgtcatgcttgaatgttttagatgtaacctttgacatatttagaactctcctcctatacaatgtttattctcagatatagaggttatgtcattttataaagacttcattgataagatggcttttattcatactaatcctcccaatgttaccccttccatcttccaagaagaaaaaaaatgcctgaatattcagaatagatatttctgatttgaaaattctaaagaattaaactggaaaagtatttcatttacttagtgctctgaatttacttttacagttttctgcagtcagtatcattaaaatggttaagtttacatttgaactgaaaatatgtataaaatctagcaattcacaaaaatgccctagaaatatagattttaatcaccattacataatgacaaaccttgttaaatgcttccacttccagtggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctcccaggggcctaggtagctgccagtccgtgattttaattgctgtcttgaagttaacaagtgttataatgaaataatctacctgatgctaaataaaggctttagaatgttccccaaaaaaaaa

SEQ ID NO: 290 - DNA, 4096 bp, Homo sapiens
ccgtggtcccggcgccgggtcccggagacagacgttacgcgggctcgagcgtcctcggggagtgccagccagagttggtgacgaccacttcctcgacgtggggcgggcggacgggaagcctggggtcgtggccaccgcctcgggagctctgggagcccgggtgaccgcgtagaaatgaacacagaagcggagcaacagcttctccatcacgccagaaatggcaatgctgaagaagtaagacaactattagagaccatggcgaggaatgaagtgattgctgacattaattgcaaaggaagaagtaagtctaacttgggctggacacctctacatctggcatgctattttggacacagacaagtggtccaggatctgttgaaggctggtgcagaagtgaatgtgttgaatgacatgggagacacgccgcttcatcgagctgcctttacaggacgaaaggagttggtaatgcttctcttagaatataatgctgatactactattgttaatgggagtggacagacagcaaaagaagttactcatgctgaagaaatcagaagcatgcttgaagctgtagaaaggactcaacaaagaaagcttgaagaattacttttagcagcagcaagagaaggcaaaacaacagaactcacagctctgctcaacaggcccaatcctcctgatgttaactgttcggatcagttaggaaatacacccttgcattgtgcagcttaccgggcccataaacaatgtgccttaaagcttctaagaagtggagcagaccctaatctgaagaacaaaaatgatcagaaacctcttgaccttgcccagggtgctgaaatgaaacacattcttgttggtaataaggtcatctacaaagcattgaaacgatatgagggccctctctggaagagttcaagattttttggctggagattattctgggtagtgttagagcatggagtcctttcatggtataggaaacagcctgatgcagttcataatatttatcgccagggatgcaaacacctgactcaagcagtatgcacggtaaaatccactgatagctgcctcttctttattaaatgctttgatgacaccattcatggcttccgggttcctaagaatagccttcagcagtcaagagaggactggctggaagcaatagaagaacattctgcttacagcactcactactgttcccaggaccagctgactgatgaggaggaggaagatacggtttctgctgcagacctgaagaaatcattagagaaagcacagtcatgccaacagcgactagatagggaaatttccaactttctcaaaatgattaaggagtgtgacatggctaaagaaatgcttccatcatttcttcagaaagttgaagttgtctcagaagcttctagagaaacttgtgtagctttgactgattgccttaatctcttcaccaaacaagaaggggtgaggaattttaaattggaacaagagcaagaaaaaaacaaaatcttgtcagaagcactggagacgctggccactgaacatcatgaattagagcagtctctggtgaaaggctctccacccgccagcatccttagcgaggacgagttctatgatgcgctgtcagattccgagtccgaaaggtccctgagtagattggaagcagtgacagcacgctcctttgaagaggaaggagagcatttgggcagtagaaaacacagaatgtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtatggcaatgtggaaattataaaccacaagactggggacaaatgtgtgttgaattttaagccatgtggcctttttggtaaggaattacacaaagttgaaggctacattcaagataaaagcaaaaagaagctctgtgccctctatgggaagtggactgaatgtttatacagtgttgaccctgccacgtttgacgcttacaaaaaaaatgataagaaaaatacagaagagaagaagaacagcaaacagatgagcacctctgaggagttggatgaaatgccagtgccggattctgaaagtgtattcattatccctggaagcgttcttctatggcgaatagccccacggcctccaaattctgcccagatgtataattttactagttttgcaatggttttgaatgaagtagacaaagacatggagagtgtgattcccaagacagactgcaggttacggcctgacatcagagccatggaaaatggagagatagatcaagctagtgaagaaaaaaaacgacttgaggaaaaacaaagagcagcccgcaaaaacaggtccaagtcagaagaggactggaagacgaggtggttccatcaaggtcctaatccctacaatggagcacaggactggatttactctggcagctactgggacagaaattacttcaatttgcctgacatttattaaaatgcatacaagtcagggtgtttggctaatctacaaataagtcttaaacctatgtttttaaatttttttcccttggtttctacttatcttttaaaaaaaaaatgaaaaaacactcatgagataactgcatttcacccaacaaaagcagggtataaggcgatattggtgatgaaagtcttaggaaaaatgcataattttgctataaaatgtacttatttggaatactattttatatagaggtaagagaacactgctggggaatatgctttttatggttgctgttgccatatttactgaaggtttatacctaaatgtaactttagctttatggaactatatagtaatcccaaatcaagttattttgaatatttttatgctgtcatgcttgaatgttttagatgtaacctttgacatatttagaactctcctcctatacaatgtttattctcagatatagaggttatgtcattttataaagacttcattgataagatggcttttattcatactaatcctcccaatgttaccccttccatcttccaagaagaaaaaaaatgcctgaatattcagaatagatatttctgatttgaaaattctaaagaattaaactggaaaagtatttcatttacttagtgctctgaatttacttttacagttttctgcagtcagtatcattaaaatggttaagtttacatttgaactgaaaatatgtataaaatctagcaattcacaaaaatgccctagaaatatagattttaatcaccattacataatgacaaaccttgttaaatgcttccacttccagtggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctcccaggggcctaggtagctgccagtccgtgattttaattgctgtcttgaagttaacaagtgttataatgaaataatctacctgatgctaaataaaggctttagaatgttccccaaaaaaaaa

SEQ ID NO: 291 - DNA, 3186 bp, Homo sapiens
agttaatatgatcctctgttgaagcaagaagacaaactgtatggtggagaaagaagtgggaaggatctgcgcggaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactggagagaaaccctatgaatttactgaatgtgggggaactgttactcatatgttgcatttcgtcgaacgtgcaagtcatgctgaagagaaaccctgtgcttctaaggagtattgacaagcccttagctagatgacaatctcattgagaagcagaaaattcatgctggagagaaactagtgaaggtagcaatacttcattgaatattagaaaatttttctagagagaaagcattgaatatactgagtatgataacatttcctctcaaaccttatcccttactctgcatttgggagatcatacacagagaagccttataaatgtaagagatgtggaaatatcttcagccaaaagtaaatcctcactcatcaagaaatttttactggagagaaaccttgtgaatgtgggaaagcttccattcagatgtcacacctcagccagcagaaaatttacagtggggaaaacccctttgcctgtaaggtatgtggaaaagtcttcagccacaaatcaaacctcactgagcatgagcattttcacacgagagagaaaccttttgaatgtaacgagtgtggaaaagcctttagccaaaagcagtatgtcattaaacatcagaacacccatactggcgagaagcttttcgaatgtaatgaatgtggaaaatcatttagccagaaggaaaacctccttacgcaccagaaaattcacactggagaaaaaccttttgagtgtaaagattgcgggaaagctttcattcagaagtcaaacctcatcagacaccagagaactcacacaggagagaagccctttgtatgtaaggagtgtggaaaaaccttcagtggcaaatccaaccttactgagcatgagaaaatccatattggagagaagccttttaaatgtagtgaatgtggaacagcctttggccagaagaagtacctcataaaacatcagaacattcacactggagagaaaccctatgaatgtaacgaatgtggaaaagccttctctcagcgaacatcacttattgtacatgtgaggattcattcaggtgataaaccttacgaatgcaatgtttgtggaaaagccttctctcagagctcatctctcactgtgcatgtgagaagccatacaggggagaagccctatggttgtaatgaatgtgggaaagctttctctcagttctcaacccttgctctgcatttgagaatacacacaggtaagaagccttatcagtgcagtgaatgtgggaaagctttcagccagaagtcacaccacattagacaccagaaaattcatactcactaaaaaccccatgaaagccttgaaagtgggaaagctttcattagaaatttgcacctcatcatgccccagaaataatccttctgaagcaaagcaccacgaatgaggttaactttaacaagtactaaaaacttaagggacaccagaaaatttgtactgaagagaaagacatgcatatgattaaaaccctgtgtccaacagagaaacctgcagcagagataatggtgaaagtttaggcacattttcactaaaagtgggaacagaaaatggaggcctgttttttattgctaccaccatagatctggagatcttcgccagtaacaagaaaaattaagttgtaaatattggaaaggaacagacaaaaatagatgacatggtcatctacaactaatattaagactcctgtggtattgattgagcagagcagaagagatttcaaaaaaagacctatgcatttattagaatttggaatatgatacaagtggcatcaggaaatgaggaaataatggaactattttttttaagtggaggtagtttgttctccaagggggaaaaatagaccatgaactatacacaaaagtgaatccagagattaaaaacagaaatatggaaaagctatgtactaaaatgcatatgaccttgggaatagggaaacattccttggaacaatttgagaaatacttagcggttctacttatgagtatgaatgctcaggaaatacgcactaggatatttactgtggcttgatttgtagtagccaaaaattagaaacaactgagaaagcccatcacgaacaatatgggaaattcttatgtaatactatatatctgtaaaatgcaacaaatgaaatccacatgtattaacagaaagatcccagaattgttgaggggggatcaagttgcagaatgatacagatagtacaatgacttttttgtaaatttgaattaaaagtttcctcataaaactcagtactatctattggtaatggatgcatatatgtatgtacatgtacatgtttttgaaacggattggaaggatacagaccaaactcttgatagtggtcacctgtgaagagtggagaagggaaaataatgagtgtgggaggtgggatgggtattggttaaaggggacttcagctttttatataaacatccacttctctttcaaaagacttcaagtaaatataagaagatactgattgattctggattgtggtatagggatatcttgtcttattttttgtacttttctgtatttttaaaatttctcaaaataggaatgggagtgaggatgggaatgctgtatctgtggaagtcatgttatactggattcatttccaattaaatactaaacattttatagaaaatatttctaaaattttatcacggatgaatggatggacttgctctctatgtaatatgaaattaatctattttattaaaatttaaaaggacagc

SEQ ID NO: 292 - DNA, 2501 bp, Homo sapiens
cgtggttcttttgcaagctctggattctctggagtttgaatgtttccagtattggaaccccaccaagtaggactgatcaggtcttacaattctaaaaccatgacctgtaactggggaagacctttgaagttctgtccaacaaagtatatgaagtttcaggaattagtgacattcagggatgtggccatagacttctctcggcaggagtgggaatacctggaccctaatcagagggacttatacagggatgtgatgttggagaactatagaaacctggtatcactgggaggacattccatttctaaaccagttgtggttgatttactggagcgaggaaaagagccctggatgattttgagggaagaaacacagttcacagagatgggggtctcactgggttgctcagctggtctctaactcctgggctcaagcagtcctcctgcattggcttcccaaagtgctgaaaatacagatggagtcttgctctgtcgcacaggctggagtgcagtggcccgatctcagctcactgcaacctccgcctcccaggttcaagcaattctcctgccacagcctccaagtagctgggattacagatttggatttacagtgtgagataatcagctacatagaagtacccacttatgaaacagatatatcctctacacaacttcagagcatatataagagagagaaactctatgaatgtaagaaatgtcagaagaaatttagtagtggttatcaacttattctacatcacaggtttcatgtcattgagagaccctatgaatgcaaagagtgtgggaagaactttcgtagtggctatcaacttactctacatcaaagatttcatactggtgagaaaccctatgaatgtacagaatgtgggaagaactttagaagtggttatcagctgactgtgcatcagagatttcatactggtgagaaaacctatgaatgtaggcagtgtgggaaggcctttatatatgcctcacacattgttcaacatgagagaattcacactggtgggaagccgtatgaatgtcaggagtgtgggagggcctttagtcaaggtggacatcttagaattcatcagagagttcatactggcgaaaaaccatataaatgtaaggaatgtgggaagacttttagtaggcgctcaaatcttgttgaacatgggcagtttcatactgatgagaagccatacatatgtgagaaatgtggaaaggcctttagaagaggtcaccagcttactgtacatcagagagttcacactggtaaaaagccatatgagtgtaaagaatgtgggaagggctataccactgcctcatactttcttctacatcagagaattcataaaggtggaaaaccctatgaatgtaaggagtgtaagaaaacctttactttgtatagaaatcttactcggcatcagaatattcatactggtgagaaactttttgaatgcaagcaatgtgggaagacctatactactggttcaaaactctttcaacatcagaaaactcatactggcgagaaaccctatgaatgcaaggaatgcggaaaggcctttagcttgtatggctaccttaaacaacatcagaaaattcatactggcatgaaacactttgaatgtaaggagtgtaaaaaaacctttactttgtatagaaatcttactcgacatcagaatattcacactggtaagaaactttttgaatgtcaggaatgtgggaaggcctatagtactggctcaaaccttattcaacatcggaaaactcatactggtgagaaaccctataaatgtaaggaatgtggcaagacctttagcttgcatggatatcttaatcaacatcagaaaattcatactggtgtgaaaccctatgaatgtaaggtatgtagaaaaacctttactttctatagaaatcttactctacatcaaagtattcatactgatgagaaaccttttgaatgtaaggaatgtgggaagacctttagacgtagttcacaccttactgcacatcagagcattcatgctgataaaaaaccctatgaatgtaaagaatgtggaaaggcctttaaaatgtatggctaccttacccaacatcagaaaattcatactggtggaaaaccttatgaatgtaaagaatgtgggaaggccttcagtcgtgcttcaaaccttgttcaacatgagagaattcatactggtgagaaaccctatgtgtgtaagcagtgtgggaaaaccttcagatatggttcagcccttaaagcccatcagagaattcataggagcataaaagtgtaagaccgtaaagagtatgagcgcgccattcatcatcagacagcccacactggtgagaaatgatggaatgttagtcttataggtatggctttagcaattgagagagttcaaaatgcagatcttgccacattagaaagcattcaatgtcagtcctgttttaatggaatatctgactattcaatggtaaattaagaaaaaaaaaaaaaaa

SEQ ID NO: 293 - DNA, 1421 bp, Homo sapiens
agcaagatggccacggtcatccccagccccctgagcctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgataagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacggtgccagctgggcgggtctcaccccccaggaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccatacgcctctgggcgggcatggggggtggtgggtgccagccaggggcatggacagagcctttttctaaagaaaaagacaaaaagttaaaaaaaaaa

SEQ ID NO: 294 - DNA, 1525 bp, Homo sapiens
agaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatgaaaaaaaaaaaaaaaaaa

SEQ ID NO: 295 - DNA, 2732 bp, Homo sapiens
gtctttatttcagtcccggatccgcgggcgcaggcccagctcaggcccccagggatggacgtcgtggaccctgacattttcaatagagacccccgggaccactatgacctgctacagcggctgggtggcggcacgtatggggaagtctttaaggctcgagacaaggtgtcaggggacctggtggcactgaagatggtgaagatggagcctgatgatgatgtctccacccttcagaaggaaatcctcatattgaaaacttgccggcacgccaacatcgtggcctaccatgggagttatctctggttgcagaaactctggatctgcatggaattctgtggggctggttctctccaggacatctaccaagtgacaggctccctgtcagagctccagattagctatgtctgccgggaagtgctccagggactggcctatttgcactcacagaagaagatacacagggacatcaagggagctaacatcctcatcaatgatgctggggaggtcagattggctgactttggcatctcggcccagattggggctacactggccagacgcctctctttcattgggacaccctactggatggctccggaagtggcagctgtggccctgaagggaggatacaatgagctgtgtgacatctggtccctgggcatcacggccatcgaactggccgagctacagccaccgctctttgatgtgcaccctctcagagttctcttcctcatgaccaagagtggctaccagcctccccgactgaaggaaaaaggcaaatggtcggctgccttccacaacttcatcaaagtcactctgactaagagtcccaagaaacgacccagcgccaccaagatgctcagtcatcaactggtatcccagcctgggctgaatcgaggcctgatcctggatcttcttgacaaactgaagaatcccgggaaaggaccctccattggggacattgaggatgaggagcccgagctaccccctgctatccctcggcggatcagatccacccaccgctccagctctctggggatcccagatgcagactgctgtcggcggcacatggagttcaggaagctccgaggaatggagaccagacccccagccaacaccgctcgcctacagcctcctcgagacctcaggagcagcagccccaggaagcaactgtcagagtcgtctgacgatgactatgacgacgtggacatccccacccctgcagaggacacacctcctccacttccccccaagcccaagttccgttctccatcagacgagggtcctgggagcatgggggatgatgggcagctgagcccgggggtgctggtccggtgtgccagtgggcccccaccaaacagcccccgtcctgggcctcccccatccaccagcagcccccacctcaccgcccattcagaaccctcactctggaacccaccctcccgggagcttgacaagcccccacttctgccccccaagaaggaaaagatgaagagaaagggatgtgcccttctcgtaaagttgttcaatggctgccccctccggatccacagcacggccgcctggacacatccctccaccaaggaccagcacctgctcctgggggcagaggaaggcatcttcatcctgaaccggaatgaccaggaggccacgctggaaatgctctttcctagccggactacgtgggtgtactccatcaacaacgttctcatgtctctctcaggaaagaccccccacctgtattctcatagcatccttggcctgctggaacggaaagagaccagagcaggaaaccccatcgctcacattagcccccaccgcctactggcaaggaagaacatggtttccaccaagatccaggacaccaaaggctgccgggcgtgctgtgtggcggagggtgcgagctctgggggcccgttcctgtgcggtgcattggagacgtccgttgtcctgcttcagtggtaccagcccatgaacaaattcctgcttgtccggcaggtgctgttcccactgccgacgcctctgtccgtgttcgcgctgctgaccgggccaggctctgagctgcccgctgtgtgcatcggcgtgagccccgggcggccggggaagtcggtgctcttccacacggtgcgctttggcgcgctctcttgctggctgggcgagatgagcaccgagcacaggggacccgtgcaggtgacccaggtagaggaagatatggtgatggtgttgatggatggctctgtgaagctggtgaccccggaggggtccccagtccggggacttcgcacacctgagatccccatgaccgaagcggtggaggccgtggctatggttggaggtcagcttcaggccttctggaagcatggagtgcaggtgtgggctctaggctcggatcagctgctacaggagctgagagaccctaccctcactttccgtctgcttggctcccccaggctggagtgcagtggcacgatctcgcctcactgcaacctcctcctcccaggttcaagcaattctcctgcctcagcctcccgagtagctgggattacaggcctgtagtggtggagacacgcccagtggatgatcctactgctcccagcaacctctacatccaggaatgagtccctaggggggtgtcaggaactagtccttgcaccccctcccccatagacacactagtggtcatggcatgtcctcatctcccaataaacatgactttagcctctgcaaaaaaa

SEQ ID NO: 296 - DNA, 911 bp, Homo sapiens
ggaaagcgtggcggctgctgctagagcctttccctttaccgcacccaagagctggagcacgaacaacgacgtcgcttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtacctcggggacctgctggagacctgccatttccaggccttctggcaagccctggatgaaaacatggacctcttggaaggtataactggctttgaagactctgtccgaaagtttatctgccatgttgtgggtatcacttaccagcacattgaccgctggctgctggccgagatgctcggggatctgtcggacagccagctaaaggtgtggatgagcaaatacggctggagtgccgacgagtcggggcagatcttcatctgtagccaagaagagagcattaaacccaagaacattgtggagaagattgactttgacagtgtgtccagcatcatggcctcctcccagtaacttcaggtgtttaataaagatgtgttgactcagaaaaaaaaaaaaaaaaaaaaaaaaaaaaaaaaaaaaaaaaaaaaaaaaaa

SEQ ID NO: 297 - DNA, 911 bp, Homo sapiens; identical to SEQ ID NO: 296

SEQ ID NO: 298 - DNA, 2033 bp, Homo sapiens
ggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaacggtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattcctttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacacagc

SEQ ID NO: 299 - DNA, 1963 bp, Homo sapiens
gtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagacccctctcaccctctggagacccaggcagggaaggtgcaggaggctcaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaac

SEQ ID NO: 300 - DNA, 1931 bp, Homo sapiens
cgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaaaaaaaaaaaaaaaaaaaaaaa

SEQ ID NO: 301 - DNA, 1184 bp, Homo sapiens
gcgactgcggggggcccctgaggcggcgggggccatggctggggtcgcgtgcttgggaaaagctgccgacgcagatgaatggtgcgacagcggcctgggctccctgggtccggacgcagcggcccccggaggacctgggttgggcgcggagttgggcccggggctgtcgtgggctcccctcgtcttcggctacgtcactgaggatggggacacggcactgcacttggctgtgattcatcagcatgaacccttcctggattttcttctaggcttctcggccggcactgagtacatggacctgcagaatgacctaggccagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggccacaccccactccacgtggccgttatccacaaagatgtggagatggtccggctgctccgagatgctggagctgaccttgacaaaccggagcccacgtgcggccggagcccccttcatttggcagtggaggcccaggcagccgatgtgctggagcttctcctgagggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacagcgacagcggagacgagggcgatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgaaaaaaaaaaaaaaaaaaaaaaaaaa

SEQ ID NO: 302 - DNA, 2067 bp, Homo sapiens
tgaagaggcgggacacagacgacgattgggcgacgaaggactctatcgcggtcaactttcctcaggatctgattggctcgtcacggtcaggttcgctgccttgcaattggtctaaacgcggagtgggcgggacgaagtgccgccttgtccccggtccaagatggctgcgtccatggcgcggcgcttgtggcctttgctgactcgtcgggggttccggccccggggaggctgcatctccaacgatagtccaaggagaagtttcactacagagaaacgaaaccggaacctcctgtacgagtatgcgcgcgagggctacagcgcactccctcagctggacatagagcggttctgcgcatgcccagaagaggccgcacacgccctggagctccgcaagggggagctgcgctcggcggacctgcccgcgatcatctcgacatggcaggagctgaggcagctgcaggagcagatccggagcctggaggaagagaaggcagctgtgactgaggcagtgcgggccctgctggcaaaccaggacagtggtgaagtgcagcaggaccccaagtaccagggtctgcgggcacgtggccgggagatccggaaggagcttgttcacctgtaccccagggaggcccagcttgaggagcagttctacctgcaggcgctgaagctgcccaaccagacccacccagacgtgcccgtcggggatgagagccaggctcgagtgctccacatggtcggagacaagccagttttctccttccaacctcggggccacctggaaattggcgagaaactcgacatcatccgtcagaagcgcctgtcccacgtgtctggccaccggtcctattacctgcgcggggctggagccctcctgcagcacggcctggtcaacttcacattcaacaagcttctccgccggggcttcacccccatgacggtgccagaccttctccgcggagcagtgtttgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctgtaagctaagaacccacccacagcagccctcgggggtgtcactgcttcctggagttcaggagaccccggacacctgggacctgtgttgctgagcccgtcctgacatctgtgttcttcctgtcagctccacgcccgggcccctggaccacggggtccacctctcctctgtccttgctgcctcagagtcagtcactgaccctgttatcattgagggtcccagtgggaagcaggacgtctgggctttacggttctagggacaggagaagcagaggaagaggcttccatccctccttccttctttcctcctacagtgctgagcaaaaagtccccaataaatggtcaggacaaaaaaaaaaaaa

SEQ ID NO: 303 - DNA, 1094 bp, Homo sapiens
agctggattcagcgtgtccgcgacctcacctttaggtcctgtgaggtcggtggaatcctggggtcctccaaatctaccaggccatctccccagtttcccagttcttcctgcgtgcgggcgagagtggttgggccctcgggaacccactcagagcgaggctaaatttacggagggactttctgttagcagcatgagggcctgtggttagacctatagaggtatttcctttgatttaagccagaaagtcctgagagcggatcggggagcatttgcggatcggtcactttttcctcctttctgagtctcttatcccctaccacagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgtaaaaaaaaaaaaaaaaaaa

SEQ ID NO: 304 - DNA, 1116 bp, Homo sapiens
cacaagcgccgcgccatggacgcagccatcttggaccggggacaaggcggcacttcgtcccgcccactccgcgtttagaccaattgcaaggcagcgaacctgaccgtgacgagccaatcagatcctgaggaaagttgaccgcgatagagtccttcgtcgcccaatcgtcgtctgtgtcccgcctcttcagtgacgcgaggcagaaccagccaatccctgcacggatagcgcccggaagaggctagaagctggattcagcgtgtccgcgacctcacctttaggtcctgtgagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgtaaaaaaaaaaaaaaaaaaaaaaaaaaaaaaaaaaaaaaaaaaaaaaaaaaaaaaaaaaaaaaaaaaaaaaaa

SEQ ID NO: 305 - DNA, 991 bp, Homo sapiens
agctggattcagcgtgtccgcgacctcacctttaggtcctgtgaggtcggtggaatcctggggtcctccaaatctaccaggccatctccccagtttcccagttcttcctgcgtgcgggcgagagtggttgggccctcgggaacccactcagagcgaggctaaatttacggagggactttctgttagcagcatgagggcctgtggttagacctatagagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaagccgaagaagcccaactcagccaatcgcaagtgctgtcgagtgcggctcagcactggccgcgaggccgtctgcttcatccctggggagggccacaccctgcaggagcaccagattgtccttgtggagggcggccgcacccaggacctgccaggcgtcaagctcaccgttgtgcgtggcaagtacgactgtggccacgtgcagaagaagtgacggctgggggcacagtgggctgggcgcccctgcagaacatgaaccttccgctcctggctgccacagggtcctccgatgctggcctttgcgcctctagaggcagccactcatggattcaagtcctggctccgcctcttccatcaggaccactattaagccataggagtcctgggggtgcaaagggtgcccctctgtcaacacccttggctcctgtgtttagaggggtggcctgaaggaccttttctgctgggacaagacactgtactgccctctgctgggaaggggttttaataaacagaccctggcgcttgtgatgtaaaaaaaaaaaaaaaaaaaa

SEQ ID NO: 306 - DNA, 2215 bp, Homo sapiens
agccgccacgccccgggagaggaccgaccgcccagaccgccggtcccggggccccctgggccacgccgatcacggggagcccctcgactgcctcccagaacaaagtgggaaagggaagcttagcccgccgctgccgcctccgagcagcccgccaggactctggctactggagatgggcgcccggctatcgcggcgacggctgccggcggacccatccctggccctggacgcgctgcccccggagctgctggtgcaggtgctgagccacgtgccgccacgctccttggtcacgcgatgccgcccagtgtgccgcgcctggcgcgacatagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtctcccacgtcttcaccaactttggcaagggcatccgctacgtatcttttgagcagtacgggagagacgtgagttcctgggtggggcactatggcgcccttgtgacccactccagtgtgagggtcaggatccgtctgtcctagcgactggactactgcctgacgttgtcagtcaagaccagccttgcagccaggtgcagtggctcacacctgtggaatcccagcacttcaggaggccgaggtgggaggatcactggagctcgggagttcaagaccagcctgggcaacatagtgaaaccgtctccacaaataatttttaaaaaattagccaggcatggtggtgccgcctgtagtcccagctactcaggaggcttgggtgggaggattgcctgagaccaggaggttgaggctgcagtgagccgtgatttcaccaccactccagcctgggtgagaaagcaagaccctatatcaatgaaaaaaaaaaaaaaaaagaccagctttgcagccagaagccagaggatacccagggacagtagggctcccaggtggctggttctcagcacaccttccatgaatctgcttgctgctgcttcagtgtggtggccatcatgctgtgtgacaaaccaggctgttcacagcttcctcagccccccagaaggggagtgtcaggaagagacatttagttcatttgcctgcaaattttcttctcctgcaaggatctcggtggactcagtcacaaaacaaaggctaaaccaggatttataagagagggcttataaatccctctgccgacgcagggagcagagacttgccggcatgttttgggggtaatgatcgtgggcagggagcagaggtccgctgaggcagtctgtccttgagactaacaaagtcatctgctgtttggggaaatctctggtgttgggaacaggcccccaaatctggccataaactggccccaaaactggccataaacaaaatatctgcagcactgtgacatgtttgtgatggccatgacccccaccctgaaggttgtgggtttactggaacgagggcgaggaacacctggcccacccagggcggaaaaccgcttaaaggggttcctgaaccacaaaccatagcataagtgatctgtgccttaacgacatgttcctgctgcagataactagccagacccatccctttatttcagcccatccctttatttcctgtaagaaatgtttttagttaatctataatctatagaaataatgcttatcactggcttgctgtcaataaatatgtgggtaaatctctgttcaaggctctcagctctgaaggccgtgagacccctgatttcccactccacaccct

SEQ ID NO: 307 - DNA, 2175 bp, Homo sapiens
atagaaatcactgagaatgatgctaagagcagcgggagcggccgtgagcccagagctaaaattagggagaagagaggagtcatgatctgggtcagcagatgacgcatgaagcaaggactctggctactggagatgggcgcccggctatcgcggcgacggctgccggcggacccatccctggccctggacgcgctgcccccggagctgctggtgcaggtgctgagccacgtgccgccacgctccttggtcacgcgatgccgcccagtgtgccgcgcctggcgcgacatagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtctcccacgtcttcaccaactttggcaagggcatccgctacgtatcttttgagcagtacgggagagacgtgagttcctgggtggggcactatggcgcccttgtgacccactccagtgtgagggtcaggatccgtctgtcctagcgactggactactgcctgacgttgtcagtcaagaccagccttgcagccaggtgcagtggctcacacctgtggaatcccagcacttcaggaggccgaggtgggaggatcactggagctcgggagttcaagaccagcctgggcaacatagtgaaaccgtctccacaaataatttttaaaaaattagccaggcatggtggtgccgcctgtagtcccagctactcaggaggcttgggtgggaggattgcctgagaccaggaggttgaggctgcagtgagccgtgatttcaccaccactccagcctgggtgagaaagcaagaccctatatcaatgaaaaaaaaaaaaaaaaagaccagctttgcagccagaagccagaggatacccagggacagtagggctcccaggtggctggttctcagcacaccttccatgaatctgcttgctgctgcttcagtgtggtggccatcatgctgtgtgacaaaccaggctgttcacagcttcctcagccccccagaaggggagtgtcaggaagagacatttagttcatttgcctgcaaattttcttctcctgcaaggatctcggtggactcagtcacaaaacaaaggctaaaccaggatttataagagagggcttataaatccctctgccgacgcagggagcagagacttgccggcatgttttgggggtaatgatcgtgggcagggagcagaggtccgctgaggcagtctgtccttgagactaacaaagtcatctgctgtttggggaaatctctggtgttgggaacaggcccccaaatctggccataaactggccccaaaactggccataaacaaaatatctgcagcactgtgacatgtttgtgatggccatgacccccaccctgaaggttgtgggtttactggaacgagggcgaggaacacctggcccacccagggcggaaaaccgcttaaaggggttcctgaaccacaaaccatagcataagtgatctgtgccttaacgacatgttcctgctgcagataactagccagacccatccctttatttcagcccatccctttatttcctgtaagaaatgtttttagttaatctataatctatagaaataatgcttatcactggcttgctgtcaataaatatgtgggtaaatctctgttcaaggctctcagctctgaaggccgtgagacccctgatttcccactccacaccct

SEQ ID NO: 308 - DNA, 2838 bp, Homo sapiens
ccagtgtggtggaattcgtccgcggtggtggcggtgcaagagagctgagggaggcgcgagggcgcggagttccaggtcgagcagttaggccgcgagcgactgcggcgccgagccgatgagtaacccgaagcccctagaggagtggtcacctgcctgagggcacttctgtcccaccagcatcagaccaggccgcaccgagtccccggcaccatgtttgggaagaggaagaagcgggtggagatctccgcgccgtccaacttcgagcaccgcgtgcacacgggcttcgaccagcacgagcagaagttcacggggctgccccgccagtggcagagcctgatcgaggagtcggctcgccggcccaagcccctcgtcgaccccgcctgcatcacctccatccagcccggggcccccaagaccatcgtgcggggcagcaaaggtgccaaagatggggccctcacgctgctgctggacgagtttgagaacatgtcggtgacacgctccaactccctgcggagagacagcccgccgccgcccgcccgtgcccgccaggaaaatgggatgccagaggagccggccaccacggccagagggggcccagggaaggcaggcagccgaggccggttcgccggtcacagcgaggcgggtggcggcagtggtgacaggcgacgggcggggccagagaagaggcccaagtcttccagggagggctcagggggtccccaggagtcctcccgggacaaacgccccctctccgggcctgatgtcggcaccccccagcctgctggtctggccagtggggcgaaactggcagctggccggccctttaacacctacccgagggctgacacggaccacccatcccggggtgcccagggggagcctcatgacgtggcccctaacgggccatcagcggggggcctggccatcccccagtcctcctcctcctcctcccggcctcccacccgagcccgaggtgcccccagccctggagtgctgggaccccacgcctcagagccccagctggcccctccagcctgcacccccgccgcccctgctgttcctgggccccctggcccccgctcaccacagcgggagccacagcgagtatcccatgagcagttccgggctgccctgcagctggtggtggacccaggcgacccccgctcctacctggacaacttcatcaagattggcgagggctccacgggcatcgtgtgcatcgccaccgtgcgcagctcgggcaagctggtggccgtcaagaagatggacctgcgcaagcagcagaggcgcgagctgctcttcaacgaggtggtaatcatgagggactaccagcacgagaatgtggtggagatgtacaacagctacctggtgggggacgagctctgggtggtcatggagttcctggaaggaggcgccctcaccgacatcgtcacccacaccaggatgaacgaggagcagatcgcggccgtgtgccttgcagtgctgcaggccctgtcggtgctccacgcccagggcgtcatccaccgggacatcaagagcgactcgatcctgctgacccatgatggcagggtgaagctgtcagactttgggttctgcgcccaggtgagcaaggaagtgccccgaaggaagtcgctggtcggcacgccctactggatggccccagagctcatctcccgccttccctacgggccagaggtagacatctggtcgctggggataatggtgattgagatggtggacggagagcccccctacttcaacgagccacccctcaaagccatgaagatgattcgggacaacctgccaccccgactgaagaacctgcacaaggtgtcgccatccctgaagggcttcctggaccgcctgctggtgcgagaccctgcccagcgggccacggcagccgagctgctgaagcacccattcctggccaaggcagggccgcctgccagcatcgtgcccctcatgcgccagaaccgcaccagatgaggcccagcgcccttcccctcaaccaaagagccccccgggtcacccccgccccactgaggccagtagggggccaggcctcccactcctcccagcccgggagatgctccgcgtggcaccaccctccttgctgggggtagatgagaccctactactgaactccagttttgatctcgtgacttttagaaaaacacagggactcgtgggagcaagcgaggctcccaggacccccaccctctgggacaggccctcccccatgttcttctgtctccaggaagggcagcggccctcccatcactggaagtctgcagtgggggtcgctgggggtggagagaacactaagaggtgaacatgtatgagtgtgtgcacgcgtgtgagtgtgcatgtgtgtgtgtgtgcaaaggtccagccaccccgtcctccagcccgcaaggggtgtctggcgccttgcctgacacccagccccctctccccctgagccattgtgggggtcgatcatgaatgtccgaagagtggccttttcccgtagccctgcgccccctttctgtggctggatggggagacaggtcagggccccccaccctctccagcccctgcagcaaatgactactgcacctggacagcctcctcttttctagaagtctatttatattgtcattttataacactctagcccctgcccttattgggggacagatggtccctgtcctgcggggtggccctggcagaaccactgcctgaagaaccaggttcctgcccggtcagcgcagccccagcccgcccacccctgcctcgagttagttttacaattaaaacattgtcttgtttaaaaaaaaaaaaaaaaaaaaaaaaaaa

SEQ ID NO: 309 - DNA, 2838 bp, Homo sapiens; identical to SEQ ID NO: 308

SEQ ID NO: 310 - DNA, 2164 bp, Homo sapiens
ctgagtctcgctggagctcttctcgcccgcccacctcatctcaacccactttccgcggggagcggcgccaagctgggccttcctcggatcaggcgtcccctgaagtcggcacgcccctctgcgtcccccttcggtcccgctaggaccccgtccgggctgccgtcgcctcgtcgctatggcgcccaccatccagacccaggcccagcgggaggatggccacaggcccaattcccaccggactctgcctgagaggtctggagtggtctgccgagtcaagtactgcaatagcctccctgatatccccttcgaccccaagttcatcacctaccccttcgaccagaacaggttcgtccagtacaaagccacttccttggagaaacagcacaaacatgacctcctgactgagccagacctgggggtcaccatcgatctcatcaatcctgacacctaccgcatcgaccccaatgttcttctagatccagctgatgagaaacttttggaagaggagattcaggcccccaccagctccaagagatcccagcagcacgcgaaggtggtgccatggatgcgaaagacagagtacatctccactgagttcaaccgttatggcatctccaatgagaagcctgaggtcaagattggggtttctgtgaagcagcagtttaccgaggaagaaatatacaaagacagggatagccagatcacagccattgagaagacttttgaggatgcccagaaatcaatctcacagcattacagcaaaccccgagtcacaccggtggaggtcatgcctgtcttcccagactttaagatgtggatcaatccatgtgctcaggtgatctttgactcagacccagcccccaaggacacgagtggtgcagctgcgttggagatgatgtctcaggccatgattaggggcatgatggatgaggaagggaaccagtttgtggcctatttcctgcctgtagaagagacgttgaagaaacgaaagcgggaccaggaggaggagatggactatgcaccagatgatgtgtatgactacaaaattgctcgggagtacaactggaacgtgaagaacaaagctagcaagggctatgaggaaaactacttcttcatcttccgagagggtgacggggtttactacaatgagttggaaaccagggtccgccttagtaagcgccgggccaaggctggggttcagtcaggcaccaacgccctgcttgtggtcaaacatcgggacatgaatgagaaggaactggaagctcaggaggcacggaaggcccagctagaaaaccacgaaccggaggaggaagaggaagaggagatggagacagaagagaaagaagctgggggctcagatgaggagcaggagaagggcagcagcagtgagaaggagggcagtgaagatgagcactcgggcagcgagagtgaacgggaggaaggtgacagggacgaggccagtgacaagagtggcagtggtgaggacgagagcagcgaggatgaggcccgggctgcccgtgacaaagaggagatctttggcagtgatgctgattctgaggacgatgccgactctgatgatgaggacagaggacaggcccaaggtggcagtgacaatgattcagacagcggcagcaatgggggtggccagcggagccggagccacagccgcagcgccagtcccttccccagtggcagcgagcactcggcccaggaggatggcagtgaagctgcagcttctgattccagtgaagctgatagtgacagtgactgagtcccagggcattcagggctggttcagacaccattattgtgagcagcaaagcacttttctagtggtctgtttgtgagcctttcacttgtttgttccccacccccaaacctttgctgttaataaagtcaacttctctttacttcccctcccagcccctatgatgtcattcagcccagcacatacctcccgcaacccccaggtgctcaaggatcttggcttgaggcttagaaacacaggccagaggcagggccaatggtttcccacaaaatgtagcacaacgaaggtcagaattcgttttttttgtttgttttttttttttccaaaataagcccagaccattaaacaagtgaaactccaacaaaaaaaaaaaaaaaaaaaaaaaaaaaaaaaaaa

SEQ ID NO: 311 - DNA, 2620 bp, Homo sapiens
gcggccgcgtcgacaaacaagtgagtctcggctggagtgcagtggtgcagtggtgcaatctcggctcactgcaacctccgcctcctgggttcaagcgattcctgtgcctcggccttccgagtagctgggattgcaggcgtgtgccaccacgcccggctaatttttttttttttttttttttttttgtatttttagtagagacagggttcttaccatgttggccaggctggtctcaaactcctgatctcaagagatgtggcctgcctccggcctcccaaagttctgggattacagggtgttgagccactctgactcagccaataatgcatatttttatttccacctgctttactgtcagaatgagtaagacagagaagaaatcattaaacaccaggattctacttgcctgctggagttttctgcctgagatgttaggagaggaaactctcaggatctcagaaaatcacatctatcacggttggtagaagtagattctagagtcagccagaatgagttcaagtcccaactgcatggctttgggcaactgactgtcctctctgaggcccagattccctttcggtaatgtggagatggcagtgtatctacctcacaaagcagtggtgagattacaataaggtaggcatgtaaagcgccaggcacatactaactgctcaataaatgggaggcatcataattgtatattattcacagcccaaggaaagtgtagcccagagagggcaaggaacttgaccctgaggtcaacacagaaaatcatgtgctggttgtatgccctggaagttgtggagagggagtgttgggtgtcttcctggggacctgtcctctgatgggctcttgttccggctaggaccccccaaaccccccaccgagctggagcctgagccggagatagaggggctgctgacaccagtgctggaggctggcgatgtggatgaaggaccctgtagcaaggcctctcagccccacgaggctgcagccagcactgccaccggaggcacagtcggtgcccgagctggaggaggtggcacgggtgttggcggaaattccccggcccctcaaacgcaggggctccatggagcaggcccctgctgtggccctgccccctacccacaagaaacagtaccagcagatcatcagccgcctcttccatcgtcatggggggccagggcccggggggcggagccagagctgtcccccatcactgagggatctgaggccagggcagggccccctgctcctgccccaccagctcccattccaccgcccggccccgtcccagagcagcccaccagagcagccgcagagcatggagatgcgctctgtgctgcggaaggcgggctccccgcgcaaggcccgccgcgcgcgcctcaaccctctggtgctcctcctggacgcggcgctgaccggggagctggaggtggtgcagcaggcggtgaaggagatgaacgacccgagccagcccaacgaggagggcatcactgccttgcacaacgccatctgcggcgccaactactctatcgtggatttcctcatcaccgcgggtgccaatgtcaactcccccgacagccacggctggacacccttgcactgcgcggcgtcgtgcaacgacacagtcatctgcatggcgctggtgcagcacggcgctgcaatcttcgccaccacgctcagcgacggcgccaccgccttcgagaagtgcgacccttaccgcgagggttatgctgactgcgccacctacctggcagacgtcgagcagagtatggggctgatgaacagcggggcagtgtacgctctctgggactacagcgccgagttcggggacgagctgtccttccgcgagggcgagtcggtcaccgtgctgcggagggacgggccggaggagaccgactggtggtgggccgcgctgcacggccaggagggctacgtgccgcggaactacttcgggctgttccccagggtgaagcctcaaaggagtaaagtctagcaggatagaaggaggtttctgaggctgacagaaacaagcattcctgccttccctccagacctctccctctgttttttgctgcctttatctgcacccctcaccctgctggtggtggtccttgccaccggttctctgttctcctggaagtccagggaagaaggagggccccagccttaaatttagtaatctgccttagccttgggaggtctgggaagggctggaaatcactggggacaggaaaccacttccttttgccaaatcagatcccgtccaaagtgcctcccatgcctaccaccatcatcacatcccccagcaagccagccacctgcccagccgggcctgggatgggccaccacaccactggatattcctgggagtcactgctgacaccatctctcccagcagtcttggggtctgggtgggaaacattggtctctaccaggatccctgccccacctctccccaattaagtgccttcacacagcactggtttaatgtttataaacaaaatagagaaactttccttataaataaaagtagtttgcacagaaaaaaaaaaaacacaaccttcggccgccccaccaagctctgtctccaaaaaaaaaaaaaaaaaaaaaaaaa

SEQ ID NO: 312 - DNA, 3286 bp, Homo sapiens
aagttctgaacttgtgaggcatctgggcctccccagaagacatttaacacagaaagcacagccctactaactagtattcttacctgtctcttcaagaatttcagaccaatcgaccgtcctgtctctttaaggcttaggaagagcagtgtggctgcccctttaaggaggcgttgcaacaaaccatattggacagacgatgggggcgacccatcgggacccgacgggcctctgactccagcaatacagcgaatcagcggctttcgggaatacatttttcggaaaaagacttcttcctcggttttctgctctgcacacgttgaaattttccccagtttttcctgcagatcgggagtcgagcaatgcctacccccgcgctcccgcaccagttgggcgctcccggatgatgccctacccctttggatccacgtggtctgcaacctggtgcgagcagcccgggctacagggttgcctgaggtgtgggtcccaggatggaggagccccaggccggcgatgctgctcggttctcttgtccccccaactttaccgcgaagcccccagcctcagagtcccctcgtttctccttggaggcgctgacgggtccagatacggagctgtggcttattcaggcccctgcagactttgccccagaatgcttcaatgggcggcatgtgcctctctctggctcccagatcgtcaagggcaaattggcaggcaagcggcaccgctatcgagtcctcagcagctgtccccaagctggagaagcgaccctgctggccccctcaacggaggcaggaggtggactcacctgtgcctcagccccccagggcaccctaaggatccttgagggtccccagcaatccctgtcagggagccctctgcagcccatcccagcaagtcccccaccacagatccctcctggcctgaggcctcggttctgtgcctttgggggcaacccaccagtcacagggcctaggtcagccttggcccccaacctgctcacctcagggaagaagaaaaaggagatgcaggtgacagaggccccagtcactcaggaggcagtgaatgggcacggggccctggaggtggacatggctttggggtcgccagaaatggatgtgcggaagaagaagaagaaaaaaaatcagcagctgaaagaaccagaggcagcagggcctgtggggacagagcccacagtggagacactggagcctctgggagtgctgttcccgtccaccaccaagaagaggaagaagcccaaagggaaagaaaccttcgagccagaagacaagacagtgaagcaggaacagattaacactgagcctctagaagacacagtcctgtccccgaccaaaaagagaaagaggcaaaaggggacggaagggatggagccagaggagggggtgacagttgagtctcagccacaggtgaaggtggagccactggaggaagccatccctctgccccctacgaagaagaggaaaaaagaaaagggacagatggcaatgatggagccagggacggaggcgatggagccagtggagccggagatgaagcctctggagtccccaggggggaccatggcgcctcaacagccagaaggagcgaagcctcaggcccaggcagctctggcagctcccaaaaagaagacgaagaaagaaaaacagcaagatgccacagtggagccagagacagaggtggtggggcctgagctgccggatgaccttgagcctcaggcagctcccacatccaccaagaagaagaagaagaagaaagagagaggtcacacagtgactgagccaattcagccactagagcctgaactgccaggggagggacagcctgaagccagggcaactccgggatccaccaagaagaggaagaagcagagtcaggaaagccggatgccagagacagtgccccaagaggagatgccagggccgccactgaattcagagtctggggaggaggctcccacaggccgggacaagaagcggaagcagcagcagcagcagcctgtgtagtctgcccccgggaaactgaggaactaaagaaagctgaaggtgcccacctgggccaccagaaggtgacacccccagaatccctccccagagactgcaccagcgcagccagcaggagcctggcctgggaggacgatttattattacactgggggtttccttggcagctggggtcatcagggtactttcaagaagggctcgtgcaggacatcaaacagcctccgggcctggatgggagggagaaaaaaatgaggaaccagtcattaaaggagctgtttcctgggtaaatctagagtggggttttggttctttattttcccctataccctcaagcatttatccattgagttacaaacaatccagttacaatctttttaagttattattattattattattttttttttttttgagatggagtctcgctctgtcgcccaggttggagtgcagtggcgcaatctcggctcactgcaagctccgcctcccgggttcacgccattctcctgcctcagcctcctgagtagctgggactacaggcccctgcccagctaattttttgtatttttttttagtagagatggggtttcaccacgttagccaggatggtctcgatctcctgacctcctgatgcgcctgcctcagcctcccagtgctgggattataggtgtgagccactgcgcctggctaagttattattatttttttgagacagtctcctggtgtcacccaggctggagtgcagtggtgtgatcttggctcactgcaacctccgcctcctgggttccaacgattctcctgcctcagcctcccgagtagctgggcctaaaggtgcccaccactatacccggctaatttttgtatttttagtagagacaggggtttcaccatattggccaggctggtctcgaactcctgacctcgtgatccacctgccttgacctcccaaagtgctaggataacaggtgtgagccaccgcaccctgccaagttattttaaaatgtaccattattattgactatagtcacctggttgtgttatcaaatagtatgtcttattcattctttctttgtgtgtgtgtgtgtgtgtgtgtgtgtgtgtggtacccattaaccttccccatctccctgccagcccctaactaccctccccagcctccaggaactatccatccactcttatctccatgagttcaattgttttgatttttagatacacaaataaataagaacatgcaatgtttgtctttctgtgcctggcttatttcactt

SEQ ID NO: 313 - DNA, 1584 bp, Homo sapiens
gttgaggcgccccgcccagtcagcaaggttgcgcgtgccctgtgagaccgccaagatggtggtgggcgcgttccctatggcgaagctgctatacttgggcatccggcaggtcagcaagccgcttgccaaccgtattaaggaggccgcccgccgaagcgagttcttcaagacctatatctgcctcccgccggctcaactgtatcactgggtggagatgcggaccaagatgcgcatcatgggcttccggggcacggtcatcaagccgctgaacgaggaggcggcagccgagctgggcgcagagctgctgggcgaagccaccatcttcatcgtgggcggcggctgcctagtgctggagtactggcgccaccaggcgcagcagcgccacaaggaggaggagcagcgtgctgcctggaacgcgctgcgggacgaggtgggccacctggcgctggcgctggaagcgctgcaggcgcaggtgcaggcggcgccgccacagggcgccctggaggaactgcgcacagagctgcaagaggtgcgcgcccagctctgcaatcccggccggtccgcttcccacgcagtgcctgcgtccaagaaataggagcttgctggatggaacctgaatttggacatggcctatgtacctaacgtggccttcttcccgcaccacccttgcctgcgctggcccagtggaaaccaccaggatcttgatgcaacttggcatttggttacccctgctgataagagcagccattacctgccactgggaccagcaggtgaagcgttgcaacatagccccctccatcatccttcacctcctatcccccactccaaaccaggacgacctgcaaggtcccagccagcaggacaccgtgggcactctggcaaatgaaaaaatggaacctggtcttgagctgaatcaatgtgttattgttacccccacccccggtttacctgatcagtgttaacctttactgggacactcatctgttacactggaacaccttcttctttttgtcaatcggcacagaccactgtaaggaaatgcagtgtgttgcagtggccttttctccccctcaccttctaaggtcagctctagctgagcatcagtgctctcttaaggaggaaaaaaacggtgcggctgggagcggtggctcacgcctgtaatcctagcaccttgggaggccgaggcgggcggatcacttgaggtcaggagttccagaccagcctggccaacatggtgaaactccgtctctactaaaaatacaaaaattagccgggtgtggtggggtgcgcttgtaatcccagctactcgggaggctgaggcaggagaattgcttgaacccatgaggtggaggttgcggtgagccaagatggcaccattgcaccctagcctgggcaacagagcaagacaccgtcttaaaaccaaaagttaaccgggcgtggtggtgggtgcctgtaatcctagctacttgggaggctgaggcaggagaattgcttgaacttgggaggtggaggccaagattgtaccactgtattccagcccgggtgacagagcaagactgtgtctcaaaaaaaaaaaaaaaaaaa

SEQ ID NO: 314 - DNA, 2269 bp, Homo sapiens
ccacccccggccccgaagctccgccacccgccgccatgagtagctttggagctggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaaaaaaaaaaaaaaaaaaaaaaa

SEQ ID NO: 315 - DNA, 2024 bp, Homo sapiens
ggcagcggtggcaggggctgcaggagcaagtgaccaggagcaggactggggacaggcctgatcgcccctgcacgaaccagacccttcgccgccctcacgatgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcctgcccctggtacctgccctggcaccaccatgtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctggggggcccccgcgcttttcgtcattccctgggtgatcgtcaggtacctgtacgagaacacgcagtgctgggagcgcaacgaagtcaaggccatttggtggattatacggacccccatcctcatgaccatcttgattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctagggggcgggatccccgtgtctgttcagttagcatggatttattgagtgccaactgcgtgccaggcccagtacggaggacgctggggaaatggtgaaggaaacagaaaaaaggtccctgcccttctggagatgacaactgagtggggaaaacagaccgtgaacacaaaacatcaagttccacacacgctatggaatggttatgaagggaagcgagaagggggcctagggtggtctgggaggcgtctccaaggaggtgacacttaagccatccccgaaagaggtgaaagagatcactttggggagagctggagaacaggattctaggcggaagcgatagcataggcaaaggcccttgggcaggaaggcgctcagccttggctggagtagaattaagtcagagccaacaggtggggagagacagagaagtgggcaggggcacccaagttgggatttcatttcaggtgcattggagattcttaggagtgtctcttgggggtaatattttattttttaaaaaatgaggat

SEQ ID NO: 316 - DNA, 762 bp, Homo sapiens
taccattcttcaagaaacggtttgaatcagactgcctttccttttgtcttcattgtcataaacatctgcccccgtgtggttctgactggccgcgaacccctacccgaagcttttattccatcattgtgcaccgttggtggggaatgctgtggcaacaggccacgcctccacttactggttggctttgcgcaggcgccaacggaagtgggtcgcaggaagaggaagtcccgcctctctctcctcaggcagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctaaaaaaaaaaaaaaaaa

SEQ ID NO: 317 - DNA, 876 bp, Homo sapiens
taccattcttcaagaaacggtttgaatcagactgcctttccttttgtcttcattgtcataaacatctgcccccgtgtggttctgactggccgcgaacccctacccgaagcttttattccatcattgtgcaccgttggtggggaatgctgtggcaacaggccacgcctccacttactggttggctttgcgcaggcgccaacggaagtgggtcgcaggaagaggaagtcccgcctctctctcctcaggcagcagcaacgcggaggaaacgggagtgaacggagagcgtagtgaccatcatgttttagcacaaccccctcagaccactctgtggagaacagactgtcagggaacgtgggtggaggcagagagaccagaaagattccaggacagagatgacagaggcttaggccatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctaaaaaaaaaaaaaaaaa

SEQ ID NO: 318 - DNA, 3407 bp, Homo sapiens
cagggagggcttggctccaccactttcctcccccagcctttgggcagcaggtcacccctgttcaggctctgagggtgccccctcctggtcctgtcctcaccaccccttccccacctcctgggaaaaaaaaaaaaaaaaaaaaaaaagctggtttaaagcagagagcctgagggctaaatttaactgtccgagtcggaatccatctctgagtcacccaagaagctgccctggcctcccgtccccttcccaggcctcaacccctttctcccacccagccccaacccccagccctcaccccctagcccccagttctggagcttgtcgggagcaagggggtggttgctactgggtcactcagcctcaattggccctgttcagcaatgggcaggttcttcttgaaattcatcacacctgtggcttcctctgtgctctacctttttattggggtgacagtgtgacagctgagattctccatgcattccccctactctagcactgaagggttctgaagggccctggaaggagggagcttggggggctggcttgtgaggggttaaggctgggaggcgggaggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaagtggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgtaccgggcccgccccctagcggccggggagggaggggccgggtccgcggccggcgaacggggctcgaagggtccttgtagccgggaatgctgctgctgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgccc

SEQ ID NO: 319 - DNA, 2075 bp, Homo sapiens
cgcgacggttcggccgggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagattctggtacaggtcaaagaggtcctctccaagctgagcacgctcgtggaaaccacactcaaagagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagggcccatgtgtgacctgctctggtcagatccacagccacagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcgaccagatggggaacaaagcctcctacatccacctccagggctctgacctacggcctcagttccaccagttcacagcagtgcctcatcccaacgtcaagcccatggcctatgccaacacgctgctgcagctaggaatgatgtgaggtgacgggcggggcggcctgcatcccagggcccctccaatcccaccggacccaggccctgggctaggggcagagcaggccccgccccagggcaatgttggacccccttttactttgtaaagtttgtatttattcccctttaggtttgcagagggggtaggggcagagtcaggggctggccagagggtctgctccctggacagagaggaaggaggtggagcagctggggctgggggcacagcctgggcattctgtggggaggccgtcctcggggtggggtggggccgagtggctgccctgcccccctcatttgcatggctcctcccccactcaagcaatagggccccgccataggaagacccccagagagagggtcagcaggggggccccgcctgcgcctcccctcctatagccccatggtggggctaggctggggctcacccccctccccagctattttatgtctgtaattaaatatgttaaaataaagtcattatcggaaaaaaaaaaaaaaa

SEQ ID NO: 320 - DNA, 2900 bp, Homo sapiens
ccgggtgggctccaggcggccggtccccggcctccccccatggccaccgccccctcttatcccgccgggctccctggctctcccgggccggggtctcctccgccccccggcggcctagagctgcagtcgccgccaccgctactgccccagatcccggccccgggttccggggtctcctttcacatccagatcgggctgacccgcgagttcgtgctgttgcccgccgcctccgagctggctcatgtgaagcagctggcctgttccatcgtggaccagaagttccctgagtgtggcttctacggcctttacgacaagatcctgcttttcaaacatgaccccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagatgctcttcggcctagtgcgccagggcctcaagtgcgatggctgcgggctgaactaccacaagcgctgtgccttcagcatccccaacaactgtagtggggcccgcaaacggcgcctgtcatccacgtctctggccagtggccactcggtgcgcctcggcacctccgagtccctgccctgcacggctgaagagctgagccgtagcaccaccgaactcctgcctcgccgtcccccgtcatcctcttcctcctcttctgcctcatcgtatacgggccgccccattgagctggacaagatgctgctctccaaggtcaaggtgccgcacaccttcctcatccacagctatacacggcccaccgtttgccaggcttgcaagaaactcctcaagggcctcttccggcagggcctgcaatgcaaagactgcaagtttaactgtcacaaacgctgcgccacccgcgtccctaatgactgcctgggggaggcccttatcaatggagatgtgccgatggaggaggccaccgatttcagcgaggctgacaagagcgccctcatggatgagtcagaggactccggtgtcatccctggctcccactcagagaatgcgctccacgccagtgaggaggaggaaggcgagggaggcaaggcccagagctccctggggtacatccccctaatgagggtggtgcaatcggtgcgacacacgacgcggaaatccagcaccacgctgcgggagggttgggtggttcattacagcaacaaggacacgctgagaaagcggcactattggcgcctggactgcaagtgtatcacgctcttccagaacaacacgaccaacagatactataaggaaattccgctgtcagaaatcctcacggtggagtccgcccagaacttcagccttgtgccgccgggcaccaacccacactgctttgagatcgtcactgccaatgccacctacttcgtgggcgagatgcctggcgggactccgggtgggccaagtgggcagggggctgaggccgcccggggctgggagacagccatccgccaggccctgatgcccgtcatccttcaggacgcacccagcgccccaggccacgcgccccacagacaagcttctctgagcatctctgtgtccaacagtcagatccaagagaatgtggacattgccactgtctaccagatcttccctgacgaagtgctgggctcagggcagtttggagtggtctatggagggaaacaccggaagacaggccgggacgtggcagttaaggtcattgacaaactgcgcttccctaccaagcaggagagccagctccggaatgaagtggccattctgcagagcctgcggcatcccgggatcgtgaacctggagtgcatgttcgagacgcctgagaaagtgtttgtggtgatggagaagctgcatggggacatgttggagatgatcctgtccagtgagaagggccggctgcctgagcgcctcaccaagttcctcatcacccagatcctggtggctttgagacaccttcacttcaagaacattgtccactgtgacttgaaaccagaaaacgtgttgctggcatcagcagacccatttcctcaggtgaagctgtgtgactttggctttgctcgcatcatcggcgagaagtcgttccgccgctcagtggtgggcacgccggcctacctggcacccgaggtgctgctcaaccagggctacaaccgctcgctggacatgtggtcagtgggcgtgatcatgtacgtcagcctcagcggcaccttccctttcaacgaggatgaggacatcaatgaccagatccagaacgccgccttcatgtacccggccagcccctggagccacatctcagctggagccattgacctcatcaacaacctgctgcaggtgaagatgcgcaaacgctacagcgtggacaaatctctcagccacccctggttacaggagtaccagacgtggctggacctccgagagctggaggggaagatgggagagcgatacatcacgcatgagagtgacgacgcgcgctgggagcagtttgcagcagagcatccgctgcctgggtctgggctgcccacggacagggatctcggtggggcctgtccaccacaggaccacgacatgcaggggctggcggagcgcatcagtgttctctgaggtcctgtgccctcgtccagctgctgccctccacagcggttcttcacaggatcccagcaatgaactgttctagggaaagtggcttcctgcccaaactggatgggacacgtggggagtggggtggggggagctatttccaaggcccctccctgtttccccagcaattaaaacggactcatctctggccccatggccttgatctcaaaaaaaaaaaaaaaaaaaaa

SEQ ID NO: 321 - DNA, 2900 bp, Homo sapiens; identical to SEQ ID NO: 320

SEQ ID NO: 322 - DNA, 3188 bp, Homo sapiens
atgatggaggagcgagcggccgccgcggtcgccgccgccgcctcctcctgccgtccgctcggctcaggcgcgggccctggccccactggggcggccccggtctccgcccctgcccccgggccgggcccggcaggtaagggaggcggcggcggaggcagccccgggcccacggcgggcccggagcccctgagcctgccggggatcctgcactttatccagcacgagtgggcgcgcttcgaagccgagaaagcccgctgggaggccgagcgcgccgagttacaggctcaggtggccttccttcagggagagaggaaagggcaggagaatctaaagacggacctggtgcggcggatcaagatgctagagtatgcgctgaagcaggaaagggccaaatatcataaactgaagtttgggacagacctgaaccagggggagaagaaagcagatgtgtcagaacaagtctccaatggccccgtggaatcggtcaccctggagaacagcccgttggtgtggaaggaggggcggcagcttctccgacagtacctggaagaggtgggctacacagacaccatcctcgacatgcggtccaagcgcgtccgttccctgctgggccgctcgctggagctcaacggggcagtggagccgagtgaaggggcccccagggctccaccaggccctgcagggctcagtggtggggagtcgctgctggtgaaacagatcgaggagcagataaagaggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaagctcccatccaaggctctggtgcccgaaatggaagacgaggatgaggaagacgactctgaggatgctatcaatgagtttgatttcctgggctcaggagaggatggggaaggggctccagaccctcggcggtgcactgtggatgggagcccccatgagctggaaagccgtcgggtcaaactccaaggcgttctggctgacctgcgggatgtggatgggctgcccccaaaagtgactggcccgcctcctggcacaccccagccccggccacatgaagacgtcttcatcatggacactatcgggggcggggaggtgagcctgggggacttggcagatctcaccgtcaccaacgacaacgacctcagctgcgatctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagcatggatccctatgatggctacgacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcgagcacggggtccccacctcagtggccttcaccagcaccgagcctgcccacatcgtggcctccttccgctctggcgacaccgtcttgtatgacatggaggttggcagtgccctcctcacgctggagtcccggggcagcagcggtccaacccagatcaaccaagtggtgagtcatccaaaccagcctctcaccatcaccgcccacgacgacaggggcatccgcttcctggacaatcggacaggtaagccggtgcactccatggttgcacacctggacgcagtcacctgcctagccgtggaccccaacggcgcattcctgatgtcaggaagccatgactgctccctgcgtctctggagcctggacaacaaaacgtgcgtgcaggagatcacggcccaccgcaagaagcacgaggaggccatccacgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggggactcccagcctcgctggaggtgcagaggcctggcctctgtctgtttgccatggagcctggtggtgctaacggccctttccccaggaatccctccccaacggctgccttccccaagcatccagcctggggatgggcccctttcaggaatcacccccgaggatggcctcggggtttccccctgtgccctgacagccgctcctggtatcagagctgctttccagagggcagcacagccagggccgggtgtctttagggatcagtttttccaagactccagaaggtgccaggttctccccttgagctcctgctcccccatcccccatcctcccagacctgggcaggagctgtgctgggagaaagggtggcagccgggagcctcagagctgagccccggcctggctgcccctcccctccggccctctccactgctttccagacactaaccaaggcttccaggccagggattgcccaacactcctagggcagccctcccagcgccccatggggtcgcccatgggtagagacggctttcttgtgcccctccctggggcatggagggtggagtgggcctcgggtccccctgaactccctgtatatctgtataaataacgggattttcatggcgccgccccacccgcattatcactgtgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagtaaaaaaaaaaaaaaaaaaaaaaaaaaaaaaaaaa

SEQ ID NO: 323 - DNA, 2856 bp, Homo sapiens
gtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattatgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaaaaaaaaaaaaaaaaa

SEQ ID NO: 324 - DNA, 781 bp, Homo sapiens
cgtgcaccctgagccggagctgcccagtcgccgcgggaccggggccgctggggtctggacgggggtcgccatgatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggagttccggaactttaagatcatttaccgccgctatgctggcctctacttctgcatctgtgtggatgtcaatgacaacaaactggcttacctggagggcattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagcaccccaccccggccccggcccctcctggaatcgcctgctcgcttccccttcccaggcccgtggccaacccagcagtccttccctcaactgcctaggaggaagggacccagctgggtctgggccacaagggaggagacttcaccccacttcctctgggccctggctgtgggcagaggccaccgtgtgtgtcccgagtaaccgtgccgttgtcgtgtgattccataagcgtctgtgcgtggagtccccaataaacctgtggtcctgcctggc

SEQ ID NO: 325 - DNA, 667 bp, Homo sapiens
cgtgcaccctgagccggagctgcccagtcgccgcgggaccggggccgctggggtctggacgggggtcgccatgatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagcaccccaccccggccccggcccctcctggaatcgcctgctcgcttccccttcccaggcccgtggccaacccagcagtccttccctcaactgcctaggaggaagggacccagctgggtctgggccacaagggaggagacttcaccccacttcctctgggccctggctgtgggcagaggccaccgtgtgtgtcccgagtaaccgtgccgttgtcgtgtgattccataagcgtctgtgcgtggagtccccaataaacctgtggtcctgcctggc

SEQ ID NO: 326 - DNA, 781 bp, Homo sapiens; identical to SEQ ID NO: 324

SEQ ID NO: 327 - DNA, 667 bp, Homo sapiens; identical to SEQ ID NO: 325

SEQ ID NO: 328 - DNA, 4545 bp, Homo sapiens
atgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtccggggaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgactacctggaagggactcagaaagccaagaagctgtttttacagcacatccaccgcctcaagcatgagcatatcgagcgtaggagaaagctgtacctggcagccctgccattagcttttgaagctcttatacctaatctagatgaaatagaccacctaggctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagaggcactatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacacggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagccatttacaaaagctccaagcagagcgttgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacgccttgcccgagagttggccaatggagattagagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgatatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctcgaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtcgggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatcgagagtctgcagagacagtttgatcaagaccacaacctggacctggcagagaaagactttacggtgaataccgtggctggtgccatgaagagctttttctcagaactgcctgaccccctggtcccgtataacatgcagatcgacttggtggaagcacacaaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagccccccggcgccaggcccagctccccctctgccgtggcttccaccgtccccttcctcacttccacgcctgtcacaagtcagccgtcgcccccacagtcgcctccacccaccccccagtccccaatgcagccactgcttccctccccgcttcatccccaccgtcccactccacagccttcccgaaacattccctggcaaacaaaggaacactag

SEQ ID NO: 329 - DNA, 7696 bp, Homo sapiens
atgatgatggcaagaaagcaagatgtccgaattcccacctacaacatcagtgtggtgggattatctgggaccgagaaggaaaagggccagtgtgggattggaaagtcttgtttgtgcaaccgcttcgtgcgcccgagtgctgacgagtttcacttggaccatacctccgtcctcagcaccagtgactttggagggcgagtggtcaataatgaccactttctctactggggagaagttagccgctccctggaggattgtgtggaatgtaagatgcacattgtggagcagactgaatttattgatgatcagacttttcaacctcatcgaagcacggccctgcagccctatatcaagagagctgctgcgaccaagcttgcatcagctgaaaaactcatgtacttttgcactgaccagctggggctggagcaggactttgagcagaaacaaatgccagacggaaagctgctggttgatggttttcttcttggtattgatgttagcaggggcatgaataggaactttgatgaccagctcaagtttgtctccaatctctacaatcagcttgcaaaaacaaaaaagcccatagtggtggtcctgactaagtgtgacgaaggtgttgagcggtacattagagatgcacatacttttgccttaagcaaaaagaacctccaggttgtggagacctcagcgagatccaatgtaaacgtggacttggctttcagcaccttagtgcaactcattgataaaagtcggggaaagacaaaaatcattccttattttgaagctctcaagcagcagagtcagcagatagctacagcaaaagacaagtatgagtggctggtgagtcgcattgtgaaaaaccacaatgagaactggctgagtgtcagccgaaagatgcaggcctctccagaataccaggactatgtctacctggaagggactcagaaagccaagaagctgtttctacagcacatccaccgcctcaagcatgagcatatcgagcgtaggagaaagctgtacctggcagccctgccattagcttttgaagctcttatacctaatctagatgaaatagaccacctaagctgcataaaagccaaaaagctcttagaaaccaagccagaattcttgaagtggtttgttgtgcttgaagagaccccatgggatgccaccagtcacattgacaacatggaaaacgaacggattccctttgatttaatggataccgtccctgcagagcagctatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacatggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagcattacaaaagctccaagcagagcgtgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacggccttgcccgagagttggccaatgagattcgagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgacatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctggggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggcaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatggagagtctgcagagacagtttgatcaagaccacaacctggacctggcagagaaagactttacggtgaataccgtggctggtgccatgaagagctttttctcagaactgcctgaccccctggtcccgtataacatgcagatcgacttggtggaagcacacaaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagccccccggcgccaggcccagctccccctctgccgtggcttccaccgtccccttcctcacttccacgcctgtcacaagtcagccgtcgcccccacagtcgcctccacccaccccccagtccccaatgcagccactgcttccctcccagcttcaagccgaacacacgctgtgagccaccaagacctggggcgacaggagaaccggtcctctctctgacggggtggcatttggccttgaacaaaaccaagtccactggggacagaggcaggggcaagtggctctccccattaccttctcaagacctcagtgggagcaccagccaatggtaccatcggctgggctgccaggtaccctgggcctggcgctgcagacctgagctggcttggacccatttgaggactgaactaggcaggcaatggctccagtgccctccctctgttccctggaccaccaccccacgtagctgctcacaccagcctccgggtgcctccctctgcttgtacagagcccatggtcgggacagtgccctggcctttgccggggaggaggatgctctgagattcagggtggggctggcaacccctgaagagaacacttcctgttggtctgtctcttcccaccttccatctgcacacacccccaaggtaagggtacagcccggctggcggcctccttgggaacgtgtaggccacggctctgccaccactaggtacctgctgagggcgctggctctgcagatcagaacaacggaggatagctttgtgcctggacccagagagtgtgggactccccgcttcatccccaccgtcccactccacagccttcccgaaacattccctggcaaacaaaggaacactaggagaaaaaatggaaaaacccttccagtaattaaaaaggaagaaaccacagaaagaaaactacagacctcaagattccactctgtgcccgcctctgccgggagggagggaggcacacaggtggagctgaccctcgtctttgtggcagcaaaaccaggatgcctggagctgtggcctgagggcctgctggggtcccactcacccacttaggtctagtcgctagatcccccgttttcccaagaagagggttcgagcccttggtggggacagctggggagatggcagtgcaggctggaacctgggctgccccagaacacagtccattacgatagaaacactaggcaccccccaggcgagagctagtggggtgcagagggccccatgccagacagcccttggggctcgttgcactttaagaaataggatctgtggtgtattccagggggcctgatggacacctttcccgggcgtctgcagctgccctgcccgtgcccgcctgcagtggttggagacgggagtggcccttcggctcccgagctccctctggggacggctggctcactgtctccagttctcaatggccaacgaaggtgcttggaaacacctaaccttgcaagttttaccgccttttgaggaacacaaatcggagaacaaacccagggttcaggcgtgttttctgtgaatgttggatgatgaatttttgtctcttctggtggagctgtgcctggccctgtaggcccagggttggctggaaggtgacatctgtgtttcgttttagctgaggttggcagaaacgttcccaaactcccccagccctggaccccagcagatgaggaaacggccccatttactgaccccgcccccttttcgaggttatgctcacctggtcagctcctcacgtaattgggggtggagggaaagcatggtggtgccctgggccgtccctgtgtgaacgcaggcaaaagcagcccagtccccctcactgcttgagctaacactgccacctcttttgtgtgagcacaaaagccacgtcccaagccacctggcccgattccacagatgtatgtgcggccagtgacttccccaggagtgtggagggggtggtgaggaggagcacctgggctctctacccctctcctcacagaagtacctgaaactaggtctggggcactcccaatgcagcgccttgtcagccaaggtgggcaggcagggactgtggcagcttatgtccaaagggagcccccatgcacaggaagccacagggttcctcttgtttcccccgctaacttcagcctctcatctgctgctccgggctgagggactagaggacatctcggtcgtttgaggggcatggccagtcgtggcaggccggccttcagcgtccggtcagggaagcgtgcagcccaaatgggcacttgcatgggagccacagaggagcgtccctggggattgttgggaccatgctgcccccactcccgcttttgttggggctctaagttctggaaggtgtgtgcacagagggtgctcatgggactcgcatgcagctctcagcactgggtgggagggcgttggcttgtccagaatggggacgtggggcagccacccctgcccagcgagagcgcagacaccgtgtgaggggacagcagcccttggtgcaaagccagagactgatcctggctctgacggctgaagagggaagacccaaggctgggtggcgtggctcgtgaatccacttagaattcttggcttgtgtcgcatactgggtgtcacggcacacatttactctgcattgtccccgtctttcccatcgcctagcgtttggggaggaacagggagagagcttcggggcgtctgtctccgtgctctcctgcctccaccgccttggttttgcttcctgctggaggcagggcacctgctgcgacccagattcttctgcaggatgtgtctgtctttgtcacggtggacagagggtgacatcataggagcagctcgctggccagaaggggatgggggcatccctgtgcctcactcagctcctgctgctcttagggaaaggaggcctgggtcaagccagcatccccttggtaaagacccccgcaggccaccaggcattctggacacgcacacacacacacacacacacacacacacacaaaacttcacagcaggccagctgcagtgacttgtcatcaagagtcacctcagctgcgcccccctcccatcctttcctatgagaagccactgctttgggggcgccggctagaaaaagtagggtgcggtggccaggagggcccctgccgcgcggggggctgggtctggttgagtcgctgctttcccgagggcagcgcagggatccggggaagctgcggcagggagcgggcgccggcttcgtggctctgaggtgtaacgggggtgggctccctccctcggaggacatcgtctgtgtccaggtcagaaagtggcccaggaagggggcagtttctgtcgcgggtccggtgggggcgcggccgc

SEQ ID NO: 330 - DNA, 2328 bp, Homo sapiens
agggggagcccaggagaccagaacatgaactccttcaattataccacccctgattatgggcactatgatgacaaggataccctggacctcaacacccctgtggataaaacttctaacacgctgcgtgttccagacatcctggccttggtcatctttgcagtcgtcttcctggtgggagtgctgggcaatgccctggtggtctgggtgacggcattcgaggccaagcggaccatcaatgccatctggttcctcaacttggcggtagccgacttcctctcctgcctggcgctgcccatcttgttcacgtccattgtacagcatcaccactggccctttggcggggccgcctgcagcatcctgccctccctcatcctgctcaacatgtacgccagcatcctgctcctggccaccatcagcgccgaccgctttctgctggtgtttaaacccatctggtgccagaacttccgaggggccggcttggcctggatcgcctgtgccgtggcttggggtttagccctgctgctgaccataccctccttcctgtaccgggtggtccgggaggagtactttccaccaaaggtgttgtgtggcgtggactacagccacgacaaacggcgggagcgagccgtggccatcgtccggctggtcctgggcttcctgtggcctctactcacgctcacgatttgttacactttcatcctgctccggacgtggagccgcagggccacgcggtccaccaagacactcaaggtggtggtggcagtggtggccagtttctttatcttctggttgccctaccaggtgacggggataatgatgtccttcctggagccatcgtcacccaccttcctgctgctgaataagctggactccctgtgtgtctcctttgcctacatcaactgctgcatcaaccccatcatctacgtggtggccggccagggcttccagggccgactgcggaaatccctccccagcctcctccggaacgtgttgactgaagagtccgtggttagggagagcaagtcattcacgcgctccacagtggacactatggcccagaagacccaggcagtgtaggcgacagcctcatgggccactgtggcccgatgtccccttccttcccggccattctccctcttgttttcacttcacttttcgtgggatggtgttaccttagctaactaactctcctccatgttgcctgtctttcccagacttgtccctccttttccagcgggactcttctcatccttcctcatttgcaaggtgaacacttccttctagggagcaccctcccaccccccacccccccccacacaccatctttccatcccaggcttttgaaaaacaaacagaaacccgtgtatctgggatatttccatatggcaataggtgtgaacagggaactcagaatacagacaagtagaaagattctcgcttaaaaaaatgtatttattttatggcaagttggaaaatatgtaactggaatctcaaaagttctttgggacaaaacagaagtccatggagttatctaagctcttgtaagtgagttaatttaaaaaagaaaattaggctgagagcagtggctcacgcctgtaatcccagaactttgggaggctaaggtgggtggatcacctgaggtcaagagttccagaccaggctggccagcatggtgaaaccccgtctgtactaaaaatacaaaaaattaactgggcatggtagtgggtgcctgtaatcccagctacttgggaggctgaggtgggagaattgctcgaaccttggaggtggaggttgtggtgagccatgatcgcaccactgcactctagcctgggtgaccgagggaggctctgtctcaaaagcaaagcaaaaacaaaaacaaaaacacctaaaaaacctgcagttttgtttgtactttgtttttaaattatgctttctattttgagatcattgcaaactcaacacaattgtaagtaatgatacagagggatcttgtgtacccttcacccagcctcccccaatggcaacatcttgcaaaactacaatgtagtctcataaccaggatattgacattgatacagtgaagatacaggacattctcatcaccacagggatccccaggatgcccacttccctccacccccacaccccagccgtgtccctaacccctggcaaccaggaatccactctccatttctataatgttgtcatttcaagaatgttattcaatggaatcatatagtatgtaacctgttttgagcttaaaaaaaaaagtatacatgactttaatgaggaaaataaaaatgaatattgaaaaaaaaaactttagag

SEQ ID NO: 331 - DNA, 1279 bp, Homo sapiens
gcggcccggcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacacccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcgctgtcccatctgctcagagagagccaagctctaaagcacatgtagccgctgagacctgctgtttctgctgggggcaggctcctcttcccccagccccgggaggctcccggagcttcctgcagccccgacctctcaggttagaccctgggccctggagcttagggattctccccaccccagccccacacctgctccttccctaatgctttgaggttttcttggttggaagctgcagctggcccaagaaagaaaataaaaaacaacacttttgcaaaaaaaaaaaaaaaaaaccc

SEQ ID NO: 332 - DNA, 3517 bp, Homo sapiens
gacgggaccgcgagcacaggccgctccgcgggcgcttcggatcctcgcgggaccccaccctctcccagcctgcccagcccgctgcagccgccagcgcgccccgtcggcagctctccatctgcacgtctctccgtgaaccccgtgagcggtgtgcagccaccatgttcagctggctgaagcggggcggggcacggggccagcagcccgaggccatccgcacggtgacctcggccctcaaggagctgtaccgcacgaagctgctgccgctggaggagcactaccgctttggggccttccactcgccggccctggaggacgcagacttcgacggcaagcccatggtgctggtggccggccagtacagcacgggcaagaccagcttcatccagtacctgctggagcaggaggtgcccggctcccgcgtggggcctgagcccaccaccgactgctttgtggccgtcatgcacggggacactgagggcaccgtgcccggcaacgccctcgtcgtggacccggacaagcccttccgcaaactcaaccctttcggaaacaccttcctcaacaggttcatgtgtgcccagctccctaatcaggtcctggagagcatcagcatcatcgacaccccgggtatcctgtcgggtgccaagcagagagtgagccgcggctacgacttcccggccgtgctgcgctggttcgcggagcgcgtggacctcatcatcctgctctttgatgcgcacaagctggagatctcggacgagttctcagaggccatcggcgcgttgcggggccatgaggacaagatccgcgtggtgctcaacaaggccgacatggtggagacgcagcagctgatgcgcgtctacggcgcgctcatgtgggcgctgggcaaggtggtgggcacgcccgaggtgctgcgcgtctacatcggctccttctggtcccagcccctcctcgtgcccgacaaccggcgcctcttcgagctggaggagcaggacctcttccgcgacatccagggcctgccccggcacgcagccttgcgcaagctcaacgacctggtgaagagggcccggctggtgcgagttcacgcttacatcatcagctacctgaagaaggagatgccctctgtgtttgggaaggagaacaagaagaagcagctgatcctcaaactgcccgtcatctttgcgaagattcagctggaacatcacatctcccctggggactttcctgattgccagaaaatgcaggagctgctgatggcgcatgacttcaccaagtttcactcgctgaagccgaagctgctggaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatgatgaagagttcgcgctggccagccacctcatcgaggccaagctggaaggccacgggctgcccgccaacctgccccgtcgcctggtgccaccctccaagcgacgccacaagggctccgccgagtgagccgggcccccctcccatggccctgctgtggctccccagctccagtcggctgcacgcacacccctgctccggctcacacacgccctgcctgccctccctgcccagctgtaaggaccgggggtctccctcctcactaccgccagacaccccggtggaagcatttagaggggaccacgggagggacaaggcttctctgtccgcccttcacacctccagcctcacgttcacttaggcacatcacacacacactggcacacgcaggcatccatccatccgtcattcattcaaatatttattgagcacctactatgtgcccagccctgttctaggcactgggcattaccatagagaacaaaatagacaaatacatctgccctcatggaaggtgacgttcccaggagagggcacctacacagtcacgcaaacacacactaattcctggcagggcccccagcccctcccctggctgagcagccctgtggctgaaatgactagcagataaacagacccccttctgctccgcttcctcctgcccagccaggcaacaccctcaaccggctccatcacatcctcaggtctcgggaccatggggggctcagaggggagacacacctactgcttcctcagatgggcccctccgcagccccttcccttgctcggggaaagcccccaattctgcccacacccatttatttccttccttccttccttcttttctttccttccttccttcttttttgtttttgcccccaattctgcccatacccatttctttctttccttccttccttcttttttgtttttgcccccagttctgtccacaccccttccctttcctgtcctgtcctttctttctttcttttttgatagaatcttgctctgtcgcccaggctggagtgcagtggtgagatctcagctcactgcaacctccacctcctgggttgaagtgattctcgtgcctcagcctcctgagtagctgggactgcaggcacgcgccaccacgcccagctaatttttgtatttgagtagagacggggtttcaccatgttggccaggctggtctcgaactccgcatctcaggtgatctgctcgcctcggcctcccaaagtgatgggattacaggcatgagccaccgtgcccggcttcacacccatttctttaaaaaggatcccgtagcaggcagaaaagccccttccatcctgctcctctgatactgtgcccccttggagatatttccgtcctccacccacgtgtctgtggctggaactgcccagcctgctcctggccccctggaagcctccccacagctggtaatctggacttaaggattgctgggccaccgcctctctgcctaccaccattccatatttaagtggagcccctacgtagaaaggccccggggctttattttagtctccttttcagggatgtcgtgggcgggggagggggttcttggtgctacagccctctccccacccctaaagggacgccgacgctgtttgctgccttcaccacatattagtgcttgaccctggcaggggaccccatggaaaagatggggaagagcaaaatacatggagacgacgcaccctccaggatgctcgctgggattcccacgcccaccactgtcccccaccccatggctgggaggggcctctgaacggaacagtgtccccacagagcgaataaagccaaggcttcttcccaaaaaaaaaaaaaaaaaa

SEQ ID NO: 333 - DNA, 3517 bp, Homo sapiens; identical to SEQ ID NO: 332

SEQ ID NO: 334 - DNA, 3517 bp, Homo sapiens; identical to SEQ ID NO: 332

SEQ ID NO: 335 - DNA, 3083 bp, Homo sapiens
cagaggcgcgcctggcggatctgagtgtgttgcccgggcagcggcgcgcgggaccaacgcaaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagctcggaagcagctcccgaaacggaccattcaggaagtcctggaagagcagagtgaggacgaggacagagaagccaagaggaagaaggaggaggaagaagaggagaccccgaaagaaagcctcacagaggctgaagtggcaacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaagcttggaactggcttcagtgatgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggatagct

SEQ ID NO: 336 - DNA, 1575 bp, Homo sapiens
ctcttcccggctccagctccgccgccagctccagcctttgctccccctcccaaagtcccctccccggagcggagcgcacctagggtccctcttccgtccccccagcccagctacccgttcagaccagcagcctcggggggcacccccccgccagcctgcctccctcccgctcagccctgccagggttccccagccatgaatctcttccgattcctgggagacctctcccacctcctcgccatcatcttgctactgctcaaaatctggaagtcccgctcgtgcgccggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggagatcctctggaccttctccatctacctggagtcagtggccatcttgccgcagctgttcatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatagccccggtcctctccatctctctcctcggcagcagcgggaggcagaggaaggcggcagaagatgaagagctttcccatccaggggtgacttttttaagaacccacctcttgtgctccccatcccgcctcctgccgggtttcagggggacagtggaggatccaggtcttggggagctcaggacttgggctgtttgtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaacctttaaaaaaaaaaaaaaaaaa

SEQ ID NO: 337 - DNA, 2414 bp, Homo sapiens
gaagatgcagtttctccgtatccgcaggcttctttcgctggcgccattacctgagttctcctccagcgtttccgcaccctctccgattagcggtcccaggagtttccagggtaaccgcgcagtagggcggatctcattaggcggaaagcgaaacccggaagtgacgctcttaccgggtgtcagcagcgagagggttcgaagatggcggcgcgcaagggtcggcgtcgcacgtgtgaaaccggggaacccatggaagccgagtccggcgacacaagttccgagggcccggcccaggtctacctgcccggccgggggccgccgctacgcgaaggggaggagctggtcatggacgaggaggcctatgtgctctaccaccgagcgcagactggcgccccctgtctcagctttgacatagtccgggatcacctgggagacaaccggacagagcttcctcttacactttacttgtgtgctgggacccaggctgagagcgcccagagcaacagactgatgatgcttctgatgcacaatctgcatgggacaaagcccccaccctcagagggcagtgatgaagaagaagaggaggaagatgaagaggatgaagaagagcggaaacctcagctggagctggccatggtgccccactatggtggcatcaaccgagttcgggtgtcatggctgggtgaagagcctgtggctggggtgtggtcagagaagggccaggtggaggtgtttgcgctgcggcggcttctgcaggtggtggaggagccccaggccctggcagccttcctccgggatgagcaggcccaaatgaagcccatcttctccttcgctggacacatgggcgagggctttgcccttgactggtccccccgggtgaccggtcgcctgctgaccggtgactgtcaaaagaacatccacctctggacacctgcggacggcggctcctggcacgtggaccagcggccattcgtgggccacacacgctctgtggaggacctgcagtggtcaccgactgagaacacggtgtttgcctcctgctcagctgacgcctccatccgcatctgggacatccgggcagcccccagcaaggcctgcatgctcaccacagccaccgcccatgatggggacgtcaatgtcatcagctggagccgccgggagcccttcctgctcagtggcggggatgatggggccctcaagatctgggaccttcggcagttcaagtctggttccccagtggccaccttcaagcagcacgtggcccccgtgacctccgtcgagtggcacccccaggacagcggggtctttgcagcctcgggtgcagaccaccagatcacacagtgggacctggcagtggagcgggaccctgaggcgggcgacgtggaggccgaccccggactggccgacctcccgcagcagctgctgttcgtgcaccagggcgagaccgagctgaaggagctgcactggcacccgcagtgcccagggctcctggtcagcacggcgctgtcaggcttcaccatcttccgcaccatcagcgtctgaggcgtcccactggctctgatcttgcttcctgcttggaaactgaagtcgaattgggctcccctggaaggggttcattcaggtctgttgactgagactggccggcctgtgggctgccgtgatggattctgtttgacgtattgttctctagaaggcctggctctgatccagtgacccctctcaccaaagaactcggtttaaccagggctctgtaagaccactcccacccagagacttgtgtggcctggtgtggcctgtgtgtcggattccttcctgtcagctgtgacccatttgacctgtgtccccagaacccagttttttgtttgtttgtttgagacggagtcttggtctgtcgcccaggctggagtgcagtagcacgatcttggctcactgcaacctccgcctcctgggttaaagtgattctctcagctcagtctcccaggtagctgggattacaggcatgtgccaccacaccccgttaatttttgtatttttagtagagacggggtttcaccatgttggccaggctggtctcaaattcttgatctcaagtgatctgtccgccccggcctcccagagtgctgggttgggattacaggcgtgagccaccgcgtccggctcaggacccagttttggctgctggttcccagcaggggactcgggggatatacagtggctgcaccaaattggaggtgtgggttcctccaacacaatttgcttctgcccgttgtcttcctgccagctgggtttggccaggatttctccgtgtgggggctacatgcgaccctctcccctcctccctgactttagaggctggtgctgtgtcgggaggaaggtcagggctcctgagcagcaataaaggaccaagaagaggc

SEQ ID NO: 338 - DNA, 648 bp, Homo sapiens
ctttccggacctggccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggccagccgaggctacaaaaactaaccctggatcctactctcttattaaaaagatttttgctgacaaaaaaaa

SEQ ID NO: 339 - DNA, 1478 bp, Homo sapiens
cagattttgcaagagccaggctcgcccaccttgtagaaggagcgccttgagtcccctctcaccctcggttgcaaagagccgaccgcttgatctggacaccccctcgcccagattgcatgatctcccgggaccctcttgagttgcacgtttctgcaccgaggacctcaaatccccgtcgctcctaggatttgcagcgttctggatactggagggttgcaggctacactcgcccgcccctgggcagacactcgtccaaaccactggagtgtgctggtgactggcaggccagcccttcgcctctccatgaacccgtgagcctgggggcaggtgccaggcgatggcgcggcctgtgagcgacaggaccccggcccctctgctgctgggcggcccggccgggacaccccctggcgggggagcgctgcttgggttgcggagccttctgcaggggaccagcaagcccaaagagccggccagctgtctcctgaaggaaaaggagcgcaaggcggccctgcctgcagccacaacccctgggccaggcctggagactgcgggcccggcggatgccccggctggggcagtggtgggcggagggtccccgcgggggcgcccggggccggtgcccgccccgggtctgttggcgccactgctgtgggagcgcacgctgccgttcggcgatgtggagtacgtagacctggacgccttcctgctggagcacgggctcccgcccagcccgccgccccccggtggcccgtcgccggagccgtcgcccgcgcggacgcccgcaccctccccagggccgggttcgtgcggctcggcttccccccgctcctctcctgggcacgcccccgcccgggctgccctcgggaccgccagcggccaccgcgcaggcctgacctctcgggacacacccagccctgtggacccagacaccgtggaggtgttgatgacctttgaacccgacccagctgatcttgccctatcaagcattcctggccacgagacctttgaccctcgaagacatcgcttctcagaagaggaacttaagccccagccaatcatgaagaaggcaagaaaaatccaggtgccggaggagcagaaggatgagaaatactggagccggcggtacaagaacaacgaggcagccaagcggtcccgtgacgcccggcggctcaaggagaaccagatatcggtgcgggcggccttcctggagaaggagaacgccctgctgcggcaggaagttgtggccgtgcgccaggagctgtcccactaccgcgccgtgctgtcccgataccaggcccagcacggggccctgtgaggctgccccacatccccacctggcggagctctcctccgccttgctgagacttacgccctgttcccttcctgccctgtggcccacgggccggccagctgggtgccccagggacgtgataatgcagataaatacatttatatttttaagaaaaaaaaaaaaaaaa

SEQ ID NO: 340 - DNA, 3373 bp, Homo sapiens
gcctggcgttccaggggcggccggatgtggcctgcctttgcggagggtgcgctccggccacgaaaagcggactgtggatctgccacctgcaagcagctcggccatgtggctccggagccatcgtcagctctgcctggccttcctgctagtctgtgtcctctctgtaatcttcttcctccatatccatcaagacagctttccacatggcctaggcctgtcgatcctgtgtccagaccgccgcctggtgacacccccagtggccatcttctgcctgccgggtactgcgatgggccccaacgcctcctcttcctgtccccagcaccctgcttccctctccggcacctggactgtctaccccaatggccggtttggtaatcagatgggacagtatgccacgctgctggctctggcccagctcaacggccgccgggcctttatcctgcctgccatgcatgccgccctggccccggtattccgcatcaccctgcccgtgctggccccagaagtggacagccgcacgccgtggcgggagctgcagcttcacgactggatgtcggaggagtacgcggacttgagagatcctttcctgaagctctctggcttcccctgctcttggactttcttccaccatctccgggaacagatccgcagagagttcaccctgcacgaccaccttcgggaagaggcgcagagtgtgctgggtcagctccgcctgggccgcacaggggaccgcccgcgcacctttgtcggcgtccacgtgcgccgtggggactatctgcaggttatgcctcagcgctggaagggtgtggtgggcgacagcgcctacctccggcaggccatggactggttccgggcacggcacgaagcccccgttttcgtggtcaccagcaacggcatggagtggtgtaaagaaaacatcgacacctcccagggcgatgtgacgtttgctggcgatggacaggaggctacaccgtggaaagactttgccctgctcacacagtgcaaccacaccattatgaccattggcaccttcggcttctgggctgcctacctggctggcggagacactgtctacctggccaacttcaccctgccagactctgagttcctgaagatctttaagccggaggcggccttcctgcccgagtgggtgggcattaatgcagacttgtctccactctggacattggctaagccttgagagccagggagactttctgaagtagcctgatctttctagagccagcagtacgtggcttcagaggcctggcatcttctggagaagcttgtggtgttcctgaagcaaatgggtgcccgtatccagagtgattctagttgggagagttggagagaagggggacgtttctggaactgtctgaatattctagaactagcaaaacatcttttcctgatggctggcaggcagttctagaagccacagtgcccacctgctcttcccagcccatatctacagtacttccagatggctgcccccaggaatggggaactctccctctggtctactctagaagaggggttacttctcccctgggtcctccaaagactgaaggagcatatgattgctccagagcaagcattcaccaagtccccttctgtgtttctggagtgattctagagggagacttgttctagagaggaccaggtttgatgcctgtgaagaaccctgcagggcccttatggacaggatggggttctggaaatccagataactaaggtgaagaatctttttagttttttttttttttttttggagacagggtctcgctctgttgcccaggctggagtgcagtggcgtgatcttggctcactgcaacttccgcctcctgtgttcaagcgattctcctgtctcagcctcctgagtagatgggactacaggcacaggccattatgcctggctaatttttgtatttttagtagagacagggtttcaccatgttggccgggatggtctcgatctcctgaccttgtcatccacctgtcttggcctcccaaagtgctgggattactggcatgagccactgtgcccagcccggatatttttttttaattatttatttatttatttatttattgagacggagtcttgctctgtagcccaggccagagtgcagtggcgcgatctcagctcactgcaagctctgcctcccgggttcatgccattctgcctcagcctcctgagtagctgggactacaggcgcccgccaccacgcccggctaattttttttgtatttttagtagagacggggtttcatcgtgttaaccaggatggtctcgatctcctgacctcgtgatctgcccacctcggcctcccacagtgctgggattaccggcgtgagccaccatgcctggcccggataattttttttaatttttgtagagacgaggtcttgtgatattgcccaggctgttcttcaactcctgggctcaagcagtcctcccaccttggcctcccagaatgctgggtttatagatgtgagccagcacaccgggccaagtgaagaatctaatgaatgtgcaacctaattgtagcatctaatgaatgttccaccattgctggaaaaattgagatggaaaacaaaccatctctagttggccagcgtcttgctctgttcacagtctctggaaaagctggggtagttggtgagcagagcgggactctgtccaacaagccccacagcccctcaaagacttttttttgtttgttttgagcagacaggctaaaatgtgaacgtggggtgagggatcactgccaaaatggtacagcttctggagcagaactttccagggatccagggacacttttttttaaagctcataaactgccaagagctccatatattgggtgtgagttcaggttgcctctcacaatgaaggaagttggtctttgtctgcaggtgggctgctgagggtctgggatctgttttctggaagtgtgcaggtataaacacaccctctgtgcttgtgacaaactggcaggtaccgtgctcattgctaaccactgtctgtccctgaactcccagaaccactacatctggctttgggcaggtctgagataaaacgatctaaaggtaggcagaccctggacccagcctcagatccaggcaggagcacgaggtctggccaaggtggacggggttgtcgagatctcaggagccccttgctgttttttggagggtgaaagaagaaaccttaaacatagtcagctctgatcacatcccctgtctactcatccagaccccatgcctgtaggcttatcagggagttacagttacaattgttacagtactgttcccaactcagctgccacgggtgagagagcaggaggtatgaattaaaagtctacagcactaa

SEQ ID NO: 341 - DNA, 3373 bp, Homo sapiens; identical to SEQ ID NO: 340

SEQ ID NO: 342 - DNA, 3056 bp, Homo sapiens
aaactgggagagggaggaagggagaaagtgagaagggaaatcggaaagagaaaagggaggaaacggcagagccagagagaaagaggaagagactgagtgtgaaggagagaggacacaggggatgactgagagacagagagagagagagagagagaatgagacagagacttaaggaagagaccctgtgagtctgacaataaaagatttggacagaaacagaaagattggagagagagagagagggagagaatgagtgagagagagactggaagagacagagatcagagggagacacagaaagtgagagtggggagagaggtagtgtaaaaggaagagagagagagagagaccgtaagagacaggagacaaagagacaaaaagtgtgagtgagcaggtgaggagagagattgagaactatgagagacagcagctaagagacaaaggaggcgggagactgcctaggtgccgcagcacccacaccgtcctcttgcccccccgtcactgggaccccagagctggcccttgatggaggggagccgacctcgcagcagcctgagcctggccagcagcgcctccaccatctcctcgctcagcagcctgagccccaagaagcccacccgggcagtaaacaagatccacgcctttgggaagagaggcaatgcgctcaggagggatcccaaccttcccgtgcacatccgaggctggcttcataagcaggacagctcggggctccgtctctggaaacgccgctggttcgtcctctccggccattgcctcttttattacaaggacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctcccccgtccccgttctgcccctgcgcggcgaccccctgccccctcaggagacacagcaccccctgcccgacctcacaccccgttgagtcgcattgatgtccgacctcctctggattggggcccccaacgccagaccctctcccgaccccctactccccgccgaggacctccctctgaggctgggggaggaaagccccccaggagtccccagcactggagtcaggagcccagaacacaggcacactctggctcccccacttatctccagctccccccgcggccccctgggacccgggcctccatggttttattgccgggtcctcccctggagtcaactttccaccaaagcttggagacagatacgctgctgaccaagttgtgcgggcaggaccggcttctgcggaggctgcaggaggagatagaccagaagcaggaggagaaggagcaactagaagcagctctggagttgacccggcaacagctgggccaagccaccagggaggctggggctcccgggagggcctggggtcgccagcgcctcttgcaggaccggctggtcagtgtgagggccaccctctgtcacttgactcaggagcgagagagggtttgggacacgtacagtggcctggagcaggagctgggcaccttaagagagacgctggagtacctgctgcaccttggttctccccaggacagagtgtctgctcagcagcagctgtggatggtggaagacacgctggcaggtctgggtggcccccagaaaccgcccccacacactgagcctgactccccatctcccgtgctccagggcgaggagtcctcagagagggagagcctgccagagtccttggaactgagctcccctaggtcccccgagactgactgggggcggcctcctggaggcgacaaagacctcgccagccctcacttaggtcttgggtctccgagggtctcccgggcttccagccctgagggtcgccacctcccttccccacagctaggaaccaaggccccggtggcccggccccggatgaatgcccaggagcagctggagcggatgcgcagaaaccaggaatgtggacggcccttccctcgcccgacctccccccggcttctcaccctgggaaggacactgtccccagccagacgccagcctgacgtggagcaaaggcctgtcgtaggacactcgggagcccagaaatggctcagaagctctgggtcctggagtagtccaaggaacaccaccccttacttgccgacttccgaaggtcaccgggagcgggttctcagcctctcccaagccctggctactgaggcgtcgcagtggcacagaatgatgacaggtggaaatttggactcccagggagaccctcttcccggtgtgccgctgcctccttcggaccccacgcgccaggagacccctccccccagatctcccccggtggctaattcgggttccacggggttctctcgccgagggagtgggcgtggaggaggtcccaccccctgggggcccgcgtgggatgccgggatcgcccctccggtcctgccacaagacgagggggcatggcctctgcgagtcactctgctacaatccagcttgtaatccgcccaaaagcggcagccaatcggagcgcgaggacgtggtctggaggtaccgccgaagatctgggaccactcagggcatcagggggcgtggtctggtccccattgcgggcccgggaggggaatggtttctatggccaaagtttggttttctcaacactgtctaaatttggattaaaactttgaactttt

SEQ ID NO: 343 - DNA, 2302 bp, Homo sapiens
ggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccaggtccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccgggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaaaaaaaaaaaaaaaaaaaaaaaaaaaaaaaaaaaaaaaaaaaaaaaaaaaaaa

SEQ ID NO: 344 - DNA, 891 bp, Homo sapiens
tcacgtgacccgggcgcgctgcggccgcccgcgcggacccggcgagaggcggcggcgggagcggcggtgatggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggtgagactcctcaagcctcctcacccccaccaccgcgccctcaccaccgcccctgccccaccgtccctgccccccgccactcctctgggaccctgggccttctggagcaggtcacagtggtgccctctccccatcttcagatcatcagatgtggtctataatgcgttttccttacgtgtctgatcaatccccgattcatctaccctgctgacctcccagtgacccctgacctcactgtgaccttgacttgattagtgccttctgccctccctggagcctccactgcctctggaattgctcaagttcattgatgaccctctgaccctagctctttcctttttttttttt

SEQ ID NO: 345 - DNA, 888 bp, Homo sapiens
tcacgtgacccgggcgcgctgcggccgcccgcgcggacccggcgagaggcggcggcgggagcggcggtgatggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaacctccttcgggacacaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 346 - DNA, 195 bp, Homo sapiens
tcacgtgacccgggcgcgctgcggccgcccgcgcggacccggcgagaggcggcggcgggagcggcggtgatggacgggtccggggagcagcccagaggcggggtttcatccaggatcgagcagggcgaatggggggggaggcacccgagctggccctggacccggtgcctcaggatgcgtccaccaagaagctga

SEQ ID NO: 347 - DNA, 741 bp, Homo sapiens
tcacgtgacccgggcgcgctgcggccgcccgcgcggacccggcgagaggcggcggcgggagcggcggtgatggacgggtccggggagcagcccagaggcggggggcccaccagctctgagcagatcatgaagacaggggcccttttgcttcaggggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcgctcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaacctccttcgggacacaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 348 - DNA, 986 bp, Homo sapiens
tcacgtgacccgggcgcgctgcggccgcccgcgcggacccggcgagaggcggcggcgggagcggcggtgatggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggctggcgtgaaatggcgtgatctgggctcactgcaacctctgcctcctgggttcaagcgattcacctgcctcagcatcccaaggagctgggattacaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcgctcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaacctccttcgggacacaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 349 - DNA, 849 bp, Homo sapiens
tcacgtgacccgggcgcgctgcggccgcccgcgcggacccggcgagaggcggcggcgggagcggcggtgatggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttggaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaacctccttcgggacacaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 350 - DNA, 3574 bp, Homo sapiens
cttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatcccaaaaaaaaaaaaaaaaaa

SEQ ID NO: 351 - DNA, 1488 bp, Homo sapiens
gttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgc

SEQ ID NO: 352 - DNA, 523 bp, Homo sapiens
gcaccaaggatggagatgctccaggggctgctgctgttgctgctgctgagcatgggcggggcatgggcatccagggagccgcttcggccatggtgccaccccatcaatgccatcctggctgtcgagaaggagggctgcccagtgtgcatcaccgtcaacaccaccatctgtgccggctactgccccaccatgatgcgcgtgctgcaggcggtcctgccgcccctgcctcaggtggtgtgcacctaccgtgatgtgcgcttcgagtccatccggctccctggctgcccgcgtggtgtggaccccgtggtctccttccctgtggctctcagctgtcgctgtggaccctgccgccgcagcacctctgactgtgggggtcccaaagaccaccccttgacctgtgaccacccccaactctcaggcctcctcttcctctaaagaccctccccgcagccttccaagtccatcccgactcctggagccctgacaccccgatcctcccacaataaaggcttctcaatccgca

SEQ ID NO: 353 - DNA, 1662 bp, Homo sapiens
ggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggtggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttgaaaaaaaaaaaaaaaaa

SEQ ID NO: 354 - DNA, 1034 bp, Homo sapiens
ccgggctcctgggtgaggccggcaagtttggagcgtggtcagacaataggggcgtggctacggctcgcggagcgcaaccaacgctctagaccagacctgggctcgagaccataactgtttggctttaacagtacgtgggcggccggaatccgggagtccggtgacccgggctgtggtctagcataaaggcggagcccagaagaaggggcggggtatgggagaagcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaaggtaacctgcttcggggcatagacagcttattctctgcccccatggacttccggggcctccctgggaactaccacaaagaggagaaccaggagcaccagctggggaacaacaccctctccagccacctccagatcgacaagatgaccgacaacaagacaggagaggtgctgatctccgagaatgtggtggcatccattcaaccagcggaggggagcttcgagggtgatttgaaggtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagacccacttactgtacatcctcaggccctctcggcagctgtaggggtggggaccggggagcacctgcctgtagcccccatcagaccctgccccaagcaccatatggaaataaagttctttcttacatctaaaaa

SEQ ID NO: 355 - DNA, 1142 bp, Homo sapiens
cttttccaagcggctgccgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaagaaaaaaaaaaaaaaaaaa

SEQ ID NO: 356 - DNA, 1882 bp, Homo sapiens
tttttgtttatttttgttttgttttgttttgtttggtatagaagtgttggaacgtacacctctttcttaaaccatcctgacaaagggaaagggaaaaatacatttcccgtgaggcgttgtgactagaacagctggaggtggacggcagagtgccgcgacgactgccaggagttgtagttctccccggccgcgtcactgcggtgtcgcccacccttcttccccgggcaggccgcggtttcctttgtggacgtggcgaggagtgcccgcggcaccccgtgcactcattggccccgccccgtgagacgctcgtgcgagctcattgggcggggggcggggctctgcgctgccagaggcggggcctgactggagagcggccgaattgggcacatttgcgggaacgcagagcggagcgtggagagcggagcgaagctggataacaggggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgccacctatggccactacgcgcccggtgaagaatttcatgacgtggaggatgcagagacctacaaaaagatgctggctcgggacgagcggcgtttccgggtggccgaccaggatggggactcgatggccactcgagaggagctgacagccttcctgcaccccgaggagttccctcacatgcgggacatcgtgattgctgaaaccctggaggacctggacagaaacaaagatggctatgtccaggtggaggagtacatcgcggatctgtactcagccgagcctggggaggaggagccggcgtgggtgcagacggagaggcagcagttccgggacttccgggatctgaacaaggatgggcacctggatgggagtgaggtgggccactgggtgctgccccctgcccaggaccagcccctggtggaagccaaccacctgctgcacgagagcgacacggacaaggatgggcggctgagcaaagcggaaatcctgggtaattggaacatgtttgtgggcagtcaggccaccaactatggcgaggacctgacccggcaccacgatgagctgtgagcaccgcgcacctgccacagcctcagaggcccgcacaatgaccggaggaggggccgctgtggtctggccccctccctgtccaggccccgcaggaggcagatgcagtcccaggcatcctcctgcccctgggctctcagggaccccctgggtcggcttctgtccctgtcacacccccaaccccagggaggggctgtcatagtcccagaggataagcaatacctatttctgactgagtctcccagcccagacccagggacccttggccccaagctcagctctaagaaccgccccaacccctccagctccaaatctgagcctccaccacatagactgaaactcccctggccccagccctctcctgcctggcctggcctgggacacctcctctctgccaggaggcaataaaagccagcgccgggaaaaaaaaaaaaaaaaaaaaaaaaaaaaa

SEQ ID NO: 357 - DNA, 1116 bp, Homo sapiens
aagcgaccgagggactgggagtcgttagtgagagtttcactcttgttgcctaggctggagtgcaatggtgcgatcttggctcatcacgaccttcgcctcccaggttcaagtgattgtcccatttcagcctcccgagtagctgggattacaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgcaaaaaaaaaaaaaaaaaaaa

SEQ ID NO: 358 - DNA, 1407 bp, Homo sapiens
ggttccagctgcccgcacgccccgaccttccatcgtaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatgaa

SEQ ID NO: 359 - DNA, 1316 bp, Homo sapiens
gtgggcagccgaggccgcgaactgcatcatggagaattttgtagccaccttggctaatgggatgagcctccagccgcctcttgaagaagtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgtgtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggg

SEQ ID NO: 360 - DNA, 1262 bp, Homo sapiens
gtgggcagccgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgtgtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggg

SEQ ID NO: 361 - DNA, 1435 bp, Homo sapiens
gtgggcagccgaggccgcgaactgcatcatggagaattttgtagccaccttggctaatgggatgagcctccagccgcctcttgaagaagtaacccccctttgcccttccctgtgtctgcccccattttccttcccctcccctccccagctgtgggctgagctagagacggggtcagagagactggagagatggtaggcgtggctgaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgtgtgttccagtatctctgattatgcggtgaagatcgtcaaagccaacaagttagaccacgtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggcgcccgatggcctcatcttcccagaccgggccacgctgtatgtgacggccatcgaggaccggcagtacaaagactacaagatccactggtgggagaacgtgtatggcttcgacatgtcttgcatcaaagatgtggccattaaggagcccctagtggatgtcgtggaccccaaacagctggtcaccaacgcctgcctcataaaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagccccgagtccccgtacacgcactggaagcagacggtgttctacatggaggactacctgaccgtgaagacgggcgaggagatcttcggcaccatcggcatgcggcccaacgccaagaacaaccgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggg

SEQ ID NO: 362 - DNA, 1607 bp, Homo sapiens
ctcccccgaagccgcgcgcccgcgcccgcgcccctcagtcggtggagcccgcagccccccttgtggcccgcggcagctccccgcccgctcggcccgcgcccgccatggtccgtccgcgccgtgccccgtaccgctccggcgccgggggccccctcgggggtcgcggccgccctccgcggcccctcgtggtgcgcgccgtccgctcgcgctcctggcctgccagcccccgaggcccgcagcctccgcggatccgggcccgctcggcccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggagaagcgcagaccctactctgactccactgcaaagctgaagcggaccctgccctgccaagcctacgtgaaccaaggcgagaacctggagaccgaccagtggccgcagaagctgatcatgcagctgatccctcagcagctgctgaccaccctgggccccctgttccggaactcccagttggcacagttccacttcaccaacagagactgcgactcgctcaaggggctctgccgcatcatgggcaacggcttcgcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggcagtgggacctggtggtgtcaactcaggcccagtccagatcgtcaacaacaagtttctggcatggagtggtgtcatggagtggcaggagcccaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactgtgcttgggagcctgtggccagcagcccccactgtacccctgcccccaggtgacacgcttctgagcaggggcccctggggacttcaactgcccagcaacatggaggatggtgtcctgaggcctccaaggacggtccccacccctctacgtttccccaataaagccttttaaaaaccaaaaaaaaaaaaaaaaaaaa

SEQ ID NO: 363 - DNA, 3253 bp, Homo sapiens
actacttctgcgcctgcgcgaccgtgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaagaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttctttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaaaaaaaaaaaaaaa

SEQ ID NO: 364 - DNA, 3399 bp, Homo sapiens
actacttctgcgcctgcgcgaccgtgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaacccaccttgtcccatccacatcaggacatcccagctggagttcaaccttcatcccttctgtggcagttaggagactgaatcaaggtccagagaaggtggaggaatcctgatactgagcgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttctttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaaaaaaaaaaaaaaa

SEQ ID NO: 365 - DNA, 3277 bp, Homo sapiens
actacttctgcgcctgcgcgaccgtgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttctttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaaaaaaaaaaaaaaa

SEQ ID NO: 366 - DNA, 3432 bp, Homo sapiens
actacttctgcgcctgcgcgaccgtgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgccgaggtggatgtccgtcttttctctgttgcagaaacccaccttgtcccatccacatcaggacatcccagctggagttcaaccttcatcccttctgtggcagttaggagactgaatcaaggtccagagaaggtggaggaatcctgatactgagcgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttctttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaaaaaaaaaaaaaaa

SEQ ID NO: 367 - DNA, 2010 bp, Homo sapiens
caagaagtggcgaagttacctttgagggtatttgagtagcggcggtgtgtcaggggctaaagaggaggacgaagaaaagcagagcaagggaacccagggcaacaggagtagttcactccgcgagaggccgtccacgagacccccgcgcgcaggcatgagccccgccccccacgcatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacagcagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggcgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagcgtaccttgaacagagggaggggaggacccatggctctccccccctagcccgggagaccaggggccttcctcttcctctgcttttatttaataaaaataaaaacagaaa

SEQ ID NO: 368 - DNA, 1258 bp, Homo sapiens
tcaggccccgcccgccctgccctcccctcccgatcccggagccatgtggcccctggccctagtgatcgcctccctgaccttggccttgtcaggaggtgtctcccaggagtcttccaaggttctcaacaccaatgggaccagtgggtttctcccaggtggctacacctgcttcccccactctcagccctggcaggctgccctactagtgcaagggcggctactctgtgggggagtcctggtccaccccaaatgggtcctcactgccgcacactgtctaaaggaggggctcaaagtttacctaggcaagcacgccctagggcgtgtggaagctggtgagcaggtgagggaagttgtccactctatcccccaccctgaataccggagaagccccacccacctgaaccacgaccatgacatcatgcttctggagctgcagtccccggtccagctcacaggctacatccaaaccctgcccctttcccacaacaaccgcctaacccctggcaccacctgtcgggtgtctggctggggcaccaccaccagcccccaggtgaattaccccaaaactctacaatgtgccaacatccaacttcgctcagatgaggagtgtcgtcaagtctacccaggaaagatcactgacaacatgttgtgtgccggcacaaaagagggtggcaaagactcctgtgagggtgactctgggggccccctggtctgtaacagaacactgtatggcatcgtctcctggggagacttcccatgtgggcaacctgaccggcctggtgtctacacccgtgtctcaagatacgtcctgtggatccgtgaaacaatccgaaaatatgaaacccagcagcaaaaatggttgaagggcccacaataaaagttgagaaatgtaccggcttccatcctgtcaccatgacttcctcacatggtctgcttagcccttctctgctccttattcccagtgttccatttgaaccagtgatccatgtcctgaaaaatgctcaatctcagctaacattccatgtttcagaagcattcaggcactgccaggcttgcagtctcccagatgttgcatccctgaaacatctcaacaacctgaatgtcccaacccagacaatggcccaggtctctcaacttcatcagtgtggcttctatgagcccagatcaccacctgaacgttctgtctgtggcacattcttaaatatttccatcagcccatctcaacaatatatgtcctataaatggaccatccttgaca

SEQ ID NO: 369 - DNA, 2196 bp, Homo sapiens
atcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcggcgagcagtgtctccgttgcttcctgtgccttggccttccagccatgtggtacctgctagggagcagtggtcccaaagtgacgtgagaggctgtacgctgttgtgaaaatgaccaagaagaaggcttcacaagtcacgagatggcagttttggagccagaagtgctctccgtgcacactacctggaggacaagaggaagtaacctcaagaatagaattccttttggggaagaaagagctggccttcaggaaaagcatcccggaggaggaagaagaagtgttatacgtcctaaagtaaggtttcaggccagcatccttcagaaaaagcatccccgaggaggaagacgaatcgttaaacatcttaggtcagctttaccagtgaggaaaccgacactgtgagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacaaaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaaggcctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaaaaaaaaaaaaaaaaaa

SEQ ID NO: 370 - DNA, 2153 bp, Homo sapiens
gcacgaggcgaatccctgcttaaaggccttgctttcttgtctaacgccgcaaccagtcctctgagttgccaacgtctttcttcttgtctcgacgccccgtcgtccggccacagcgattctctgcttagcaggatcggtccacagcgggacgtgagtccctttcctcctcgcggcttaccgcctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggatgaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggttttcatcatgccttgtcttttttaactgagaaaggagattttttgaaaagagtacaattaaaaggacattgtcaaaaaaaaaaaaaaaaaaa

SEQ ID NO: 371 - DNA, 2855 bp, Homo sapiens
gaggaggggaggcctcctccgccgccgccatcttggaccgggcccggtcagcttccgcggagccatcggcagacgccgcggcctcccttgagccccgacccccgtcgtcagaacaaccccgggcccactcccccaaccccacttccgcttcgcgccgctatcgcgatagcgcccgggcccggggcgcgagaaaaaggcggcgggcgctcgcctcccccgcctgtcgcgatacgctcctcagcggcggcgccagctcctgtgcgtccgtctccaagagagtatgaagagagtgcgtctgtagggcagggaagatggcggacaagcgcaaactccaaggtgagattgatcgctgcctcaagaaggtgtccgagggcgtggagcagtttgaagatatttggcagaagctccacaatgcagccaacgcgaaccagaaagaaaagtatgaggctgacctaaagaaggagattaagaagctacaacggctgagggaccaaatcaagacatgggtagcgtccaacgagatcaaggacaagaggcagcttatagacaaccgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggataagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctccccccccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggtggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatgacggctggc

SEQ ID NO: 372 - DNA, 2529 bp, Homo sapiens
gttctcgactattgccgaagtgagccgaagtttgtggccccgcttccggagaactcaagctcccgattgtgcccgaaggaacccgaagggagaccccgcctcattcctcacgccgagctccagaccccgcctcctttccagagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgcccctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaag

SEQ ID NO: 373 - DNA, 1364 bp, Homo sapiens
cacctcgactgcgaattactgtttatgaggtgactcgctggttctatcggtggacagtgggacattctgaagggaggcaaggaggcggactgagcgctcccaattggggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggaggtcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccctgaggacacctcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgttaaaaaaaaaaaaaaaa

SEQ ID NO: 374 - DNA, 691 bp, Homo sapiens
cccgcgcaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttaaaa

SEQ ID NO: 375 - DNA, 2052 bp, Homo sapiens
ggcccaggcaccggtgggccccggagcgagcctgccccgccgggactccgcgtctgtgcgtcagccccgcccgttgtcctggcaacaacccgttgcccgggcaaccagctttgctcttaccccgcttgagaggagcccggctgttgctctgggcaacgcggtctgctggttcccacgtctgccttcgcccgcttccggttcagaccctgcggaggggcgaggacgaggcagaagtcagcgggatgcctgtggggccgtggaggaagagggtatccctttaggatggaactaggtcctggacaccccctctcaagtgcggggaggctgatactacaactcccagcatgactcgcggtggctgtccggtttctgcgcggctgttcgcgcaaaggcctcatgggagttggagttctttgttgtgcgtggggctcaaaggacgtctggggtgggaatgggggactagggtgcttgagtgtctctgcagaaaagactccaggaccccgccaccatgttcccggagcccccaaccccggggcctccatcgcccgacacgcctcccgactccagtcgcatcagccacggcccagtgcccccctgggccctggccaccatcgtrctggtctcaggcctcctcatcttcagctgctgtttctgtctctaccggaagagctgtcggaggcggacaggcaagaagagccaggcccaagcccaggtccaccttcaggaagtgaaggggctgggccagagttacatagacaaggtgcagccagaagtagaggagctggagccagcaccatccgggccagggcagcaggtgscagacaagcatgagctaggacgactgcagtactccctggattatgacttccagagtggccagctgctggtgggcattctgcaagcaatgggattggcagccttggatcttggtggctcctcggacccctatgtgcgggtctacctgctgmcggacaaacggaggcggtacgagaccaaggtgcatcggcagacgctgaaccctcactttggggagaccttcgccttcaaggtmccctacgtggagctggggggcagggtgctggtcatggcggtgtacgacttcgaccgcttctctcgcaatgacgccatcggggaggtgcgggtccctatgagctccgtggacctggggcggccagtgcaggcctggcgggagctgcaggcggctccgcgggaggagcaggagaagcttggggacatctgcttctccctccgctatgtccccacggccgggaagctcaccgtcatcgtcctggaggctaaaaacctgaagaagatggacgtaggaggactgtcagatccatacgtcaaggtccacctgctgcagggcggcaaaaaggtgcggaagaagaaaaccaccatcaagaagaacactctgaacccctattacaacgaagctttcagcttcgaggtgccctgtgaccaagtccagaaggtgcaggtggagctgaccgtgctggactacgacaagctgggcaagaacgaggccatcgggagggtggccgtgggggcggccgccggcggggctggcctgcggcactgggcggacatgctggccaacccgcggcggcccattgcccagtggcactcgctgcggcccccggaccgagtgaggctgctgcctgcgccctgactcccaccccaagcccccggccaagcctggactctagcccctgaccccagactcccgagaccggccaaagccaagccagccccacccttaagcttcctctgacggttaccctccccccaccttccaccccaaccatctgaaccattcctgtcttctcacccccaacgatgccaatcacgacaactttccagcacactcccccgaccctcgcggacacacccagatgccccagggaccccgggaagggaaggcagcctggtttctcctgcccccgggtcctgccccctgctttgacaatcagccatcctcgtctgctctcctctctcttccaacacagcccatccctgcactgctcctgaggccaaataaatattcagcagctc

SEQ ID NO: 376 - DNA, 1726 bp, Homo sapiens
gggaaggcatttgagccattttggggtgtatagatgtagtaagacgatgggttccgtagtggggagaggtgactagacttcgaggtgctaagtgtaggaacaggatggaaaagccctagtgaaatgtggggaattgggttagtggggctctggggaggtacctagagaggaagtgagggaggccacggaatatgaagatggggaggccctgcggcatgtagtggggacggagggccaggaggccgatacgggggccggtgggggggtagggggcggcaaagggaggggaagtaaactgaactggggctgggcaacaggaaaaaagaagaaaccacagattagagaaatctcggcggtcaggaggcccggggtctaagatgtaaagaggtaaacagatttagggattgattgtctgctggggtgggttgagaggagaaaagggaagaaaagtcgggggactacgtcctcagacctgacctgagtggtgagaggtggacccaggaggagtggcaggtggtggcggggttttgcagagctcagttggaggccctctccgaggcagcttgatggaacgtgggagagccgggctggagtcacagtttttattttgctagggaggtagtcagtggcgcacaaagggtaacaagcagtgatagtggggatgctttccattttaggaaacttttcctaaaaggaagtggcaattttaactaatctcccctccgccgctcccagctgccactccagatgctgctgctgccgccgcggccaccccaccctcggtcctcctctccggaggccatggacccaccgccccccaaggctccccctttccccaaggcggaaggcccctcctccactccttcctcggcggcggggccccgacccccgcggctgggccgccacctcctcatcgacgccaatggggtcccctacacatacacggtgcagctggaggaggagccccggggcccgccccagcgcgaggcgcccccaggagagcccggccctcgcaagggctacagctgcccggagtgcgcccgtgtctttgccagccctctgcggctgcagagccaccgcgtgtcgcactcggacctcaagcccttcacgtgcggcgcctgcggcaaggccttcaagcgctccagccacctgtcgcggcatcgcgccacgcaccgcgcccgcgccgggccgccgcacacctgcccgctctgcccacgccgcttccaggacgccgcggagctggcgcagcacgtgcgcctccactaagctcgagacccggcctgtgctgccctgcccgtctcagggccaccaagtctgacccacacagcgtcactcactcccacacacaccccctggctctgctgaggttactgccttaccctgggcctcagccccaccttccaaagggaggagcatcattccttccttaccccctttctagctgtgtgatgtagaccaaagtcgttgcccctccctgggcctgggaaccagtcggaactgggttccagtccagctgtgctgtgtgagcctgtgcaagtgacatgacctctctaaaccttggttttctgctctctggagcggtgaaccggtggttgtctgcggggaagagatgataaagagcacgggcacggtctggttcatttctgtatctaccccccttccgcccacgcccccgaccctttgctcaataaacattccgcactccaaaaaaaaaaaaaaaaaaaaa

SEQ ID NO: 377 - DNA, 1707 bp, Homo sapiens
gaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgctggtgagccccccgagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggatgtgcgggacgagtgcagcaagtacgggcttgtcaagtccatcgagatcccccggcctgtggacggcgtcgaggtgcccggctgcggaaagatctttgtggagttcacctctgtgtttgactgccagaaagccatgcagggcctgacgggccgcaagttcgccaacagagtggttgtcacaaaatactgtgaccccgactcttatcaccgccgggacttctggtagaggcggctgggggagggtgggggcagggctggctgggggcttctccccactcccgcccccccccttatccccctctgaagacgatgggcagaggagtgacagccgcagacacacgacagccggcagcaactggaatggcagcaattaagggtggggagcgggggttggggggttggggggttagggcagggaggggactggggaagtgcgcacacagccccacacagacaacacgcacg

SEQ ID NO: 378 - DNA, 2430 bp, Homo sapiens
ctgttgcttcccgtctcctcggcggctcccctcccccgcccggctctccgcgccccttctgggcggcggggcggcggagccgtcggcgtgcggccctccttgcgttcgtgcgtgcgcccgtggcccggcgcacgtcccgcgacaccgaggccgagcggggcagggggctgaccgccatgaccccccagagcccggcgtgagggggccgagatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccaggaggagcggatccgtcgcggggatgacctgcggctgcagatggcaatcgaggagagcaagagggagactgggggcaaggaggagtcgtccctcatggaccttgctgacgtcttcacggccccagctcctgccccgaccacagacccctgggggggcccagcacccatggctgctgccgtccccacggctgcccccacctcggacccctggggcggcccccctgtccctccagctgctgatccctggggaggtccagcccccacgccggcctctggggacccctggaggcctgctgcccctgcaggaccctcagttgacccttggggtgggaccccagcccctgcagctggggaggggcccacgcctgatccatggggaagttccgatggtggggtcccggtcagtgggccctcagcctccgatccctggacaccggccccggccttctcagatccctggggagggtcacctgccaagcccagcaccaatggcacaacagccgggggattcgacacggagcccgacgagttctctgactttgaccgactccgcacggcactgccgacctccgggagcagcgcaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggaggcccagccactggcccttccgtcaccaaccccttccagcccgcgcctcccgcgacgctcaccctgaaccagctccgtctcagtcctgtgcctcccgtccctggagcgccacccacgtacatctctccccttggcgggggccctggcctgccccccatgatgcccccgggccccccggcccccaacactaatcccttcctcctataatccagggcggaagggggcctggctccatccggctgccccattccggctccctgggagatcagtgttgtgagtgcatgtgaaatgggggatccccacccccagtgcccttccccttcctggggcccactcacactacaccctcttcctttcccaccccacctccccggagagaaactggacatggggcctggggaggggagctggccagaggaggacccctttcccgtggcattagaagggggaggggtggctggggcccccacccattccccctccctccaaactcccaacccccagtcagtgtttgagcctcctcgttcccctcacgcacccgctcacgcaccctcggtgaatccttggtgatgattttggcaactttgggaataaatggcaattcccacgggcttggcaaaaaaaaaaaaaaaaaaaaaaaaaaaaaaaaaaaaaaaaaaaaaaaaaaaaaaaa

SEQ ID NO: 379 - DNA, 1877 bp, Homo sapiens
atgtacactgtcttgttggggagcggccaggctagctccaggccagttctcggtgtcctgggggacccagacatggagctgcgggaagaagcctggtctccggggccgctggattctgaggaccagcagatggccagtcacgagaacccagtggacatcctcatcatggatgatgacgacgtccccagctggcctcccaccaagctgtccccgccccagtctgcgcccccagccggcccgcctccccggccgcggccgcccgccccctacatctgcaacgagtgtggcaagagctttagccactggtccaagctgacgcggcaccagcgcacgcacaccggcgagcggcccaacgcctgcgccgactgcggcaagaccttctcgcagagctcgcacctggtgcagcaccggcgcatccacacgggcgagaagccctacgcctgcttggagtgcggcaagcgcttcagctggagctccaacctcatgcagcaccagcgcatccacacgggcgagaagccctacacctgccccgactgcggccgcagcttcactcagagcaagagcctggccaagcaccggcgctcgcacagcggcctcaagcccttcgtgtgcccgcgctgcggccgcggcttcagccagcccaagagcctcgcgcgtcacctgcggctgcacccggagctgtcggggcctggcgtggcggccaaggtgctggcggctagcgtccggcgggccaaggggcccgaagaggcggtggcggcggacggcgagatcgccatccccgtgggcgatggcgagggcatcatcgtggtgggcgcgccgggcgagggggccgcggccgcggcagccatggcgggcgcgggggcaaaggccgcggggccccggtcgcggcgcgccccggcccccaagccgtacgtgtgtctggagtgcgggaagggcttcgggcacggggccgggctcctggcgcaccagcgggcccagcacggggacgggctcggggcggcggggggcgaggagccggcccacatctgcgtggagtgcggggagggcttcgtgcagggcgccgcgctccggagacacaagaagatccacgcggtgggcgcgccctcggtctgcagcagctgcggacagagctactaccgcgcgggcggggaggaggaggacgacgacgacgacgaggccgcgggcgggcggtgccccgagtgccgcggtggggagggccggtaggggaggggcccgggggggggggcgggcagggcccctcgggcttggcgggagcgacgacgtgcaagaccaagagacccagggagaagcggacggggtgcgatggaccccgcggcatccccggctccccgccctcctctgtccctgcgccgtccgtgggggggcactggggcgtattagggcccgttcacttctccgcctcgagactctgccccctcagcctggcccgcccttcctaagttatcggcctgcgagccggagagacaatggagagaactgcagaggccgagtggcgaccaggccccaagcggaaggccattttccctgctcttcctcagttgtccggggcgggggtggggggtgctgcgaggaatggagaaaccaggccctttagaggatcccagagagggaagagaaccaggggcccttttctcttttagaattttcttttaatcagcccaccttttgactccccgcccgccccaatccattatttttttctgccttccgggtcccatccttagagctcgagtcgttccttcccctcctggattccgggtagcagaggcagcgccgcaggaggcgggtgcccgtttgtcccaggcctgggcgtggtggaggaaggggtgctggaacaataaacggcactatccaaa

SEQ ID NO: 380 - DNA, 2059 bp, Homo sapiens
cggggcttcatggggagttgttgggctgaacgagcggctcggagtatgggattgggggagggggacgggggagtttggcgcaaagcctgctggggcatggagtcccggcgagctttgtgcgcatgtgcggggaggtgagggggcttggggggcctcgcctgagagagtgaggacaggctgcgggaggagctgcaggactgaggtacagaggccaggggcccagggcaggacccagcctggacttgactccctgggatcccaggaagggcacaccctttcctcaccacccgagtgagcgctgccccctcacagagacctctttgccccctgggccaggcagagcaggcgctgcggtccgggaggccccatggaggtggcggtgcccgtgaagcaggaggccgagggcctggcgctggactccccgtggcaccgcttccgccgcttccacctgggcgacgcgccgggcccgcgggaggcgctggggctgctccgcgccctgtgccgggactggctgcggcccgaggtgcacaccaaggagcagatgttggagctgctggtgctggaacagttcctgagcgcgctgcccgccgacacgcaggcctgggtgtgcagccggcagccgcagagcggggaggaggcggtggccctgctggaggagctctgggggccagcagcctcccccgatgggtcgtcagcaacgagggtgcctcaggatgtgacgcagggccctggggccacaggtggaaaggaggacagtgggatgattcccttagcaggcaccgcccctggggctgaggggccggcgcctggggactcccaggctgtgcgcccctacaagcaggagcccagcagccccccgctggcgcctggcctgcccgccttcctagcggccccgggcaccacgtcctgccccgagtgcggcaaaacgtccctgaaaccagctcacctgctgcgccaccggcagagccactcgggcgagaagccgcacgcctgccctgagtgcgggaaggcctttcggcgcaaggagcacctgcggcgccaccgcgacacgcaccccggcagccccggcagccccgggcccgcgctgcgccctctgcccgcccgtgagaagccccacgcgtgctgcgagtgtggcaagaccttctactggcgcgagcacctggtgcgccaccgcaagacgcactcgggagcgcggccctttgcctgctgggagtgtggcaagggcttcgggcgccgcgagcacgtgctgcgccaccagcgcatccacggccgggcagcggccagcgcgcagggggcggtagctccgggcccggatggtggaggccccttcccgccctggcccttgggttagccgcctcccggccagcgccatctcccgcccttggtgctgcccccgggcggtacctgctctctcccagcgccacttggcctcttcctctcctccttccctcccatcgtcctcctccacctgcgcctcccttgtctgaacttcccaacgccttcctattcctttccaactccttttcccccaaatttcactttccttctcaggtctcacctcagccccccccttctccctgatttctcggcctctctctctgtgtgaaggggcctctccctaatgtctcctccttcccccctcttctctctcctgcggcccagcctccctctccctcctccattcctctctccctgcccttttcctgcctgaagagcagaggtgaggacctgggacccctgaggggcaggccaggaggagctcgggcgcaggccaggcccccttggtgaagcagaggctgaaggaaaggggtctgggtcttgtccctaggaattctcctccctcaggagattgggggttgggggaggcagcgggtgatggctctgaagctgaacccagggcctggctgtggtcttcttggtcttgctgccccctgtgacccaaaggcatgggatggacagagatgcctgcccccgtgaagctggttggggagggcagttcaccagcatccatagagtaataaagtcactgtgtgtagacccggaaaaaaaaaaaaaaaaa

SEQ ID NO: 381 - DNA, 2059 bp, Homo sapiens; identical to SEQ ID NO: 380

SEQ ID NO: 382 - DNA, 6580 bp, Homo sapiens
ttttcttctgcacttctgtctggagaggtctgtagccactgagggccccggtcggggccgctttgcaggtccctagtcaggaccgagcaggggagtaggataggaatccccgccgcacctttgtacgagcctgaccccttccgtgggtttgttcctgggtcgccgtcaagctgcggtctctcctcccccgcccttcagccccgcggtctccaggggcggcgccctgggtctggaacgcggttgccaccgaggaggcggcggccctgcgtctggaacgccgttgccaccgaggaggcggcggccccgagcgcgcctggaagccccgggcaaccggccagggtcgggcacaggtggggtccgtcaggccgcccggggctcctctgtcccagctctgcggcccagggggtgacgtgatggcggcagcggtgctgacggaccgggcccaggtgtctgtgacctttgatgatgtggctgtgactttcaccaaggaggagtgggggcagctggacctagctcagcggaccctgtaccaggaggtgatgctggaaaactgtgggctcctggtgtctctggggtgtcctgttcccaaagctgagctgatctgccacctagagcatgggcaggagccatggaccaggaaggaagacctctcccaagacacctgtccaggcgacaaaggaaaacctaagaccacagaacctaccacttgtgagccagccttgtcagagggaatctcacttcagggacaagtgacacaaggaaactcagtggactcacagttggggcaagccgaggatcaggatgggctatcagaaatgcaggaaggacacttcagaccaggaatagatccccaggagaagtctcctgggaagatgagccctgaatgtgatggtttagggacagctgatggtgtgtgttcaaggattggacaggagcaagtctctccaggagatagagtccgtagccataactcatgtgagtcaggtaaagatcccatgattcaggaagaggaaaataactttaaatgcagtgaatgtggaaaagtatttaacaagaaacacctccttgctggacatgagaaaattcactctggagttaagccctatgaatgcacagaatgtgggaaaacctttattaagagcacacatctcctgcaacatcacatgatccacactggggagaggccctatgagtgcatggagtgtggaaaggccttcaaccgcaagtcataccttacccagcaccagcggattcacagtggagagaagccttacaagtgcaatgaatgcggaaaggccttcacccaccgctccaattttgtcttgcataacaggagacacactggagaaaaatcctttgtgtgcacagaatgtggccaagtctttcgacataggccaggctttctccggcactatgttgtccacagtggtgagaatccctatgagtgcttggagtgtggcaaggtcttcaaacacaggtcatatctcatgtggcaccagcagactcataccggggagaagccctatgagtgcagtgaatgtgggaaggtcttcttggagagtgcagccctgattcaccactatgtcatccacactggagagaagccctttgagtgcctcgagtgtgggaaggctttcaaccaccgatcctacctcaagaggcaccagcggattcacactggggagaagcccttcgtgtgcagtgaatgtggaaaggccttcacccactgctctacttttatcttgcataaaagggcccacactggagaaaagcctttcgagtgcaaagagtgtgggaaagcctttagcaatcggaaggacctcattcgccacttcagcatccacactggagagaagccctatgagtgcgtggagtgtggaaaggccttcacccgcatgtcgggcctcacgaggcacaagcggattcatagtggagagaagccctatgaatgtgttgagtgtgggaaatcgttttgctggagcacaaacctcattcgacatgccattatccacactggagagaagccctataaatgtagtgaatgtggaaaggccttcagtcgcagctcgtccctcactcagcatcaaaggatgcatactgggaaaaatcccatcagtgtaacagatgtgggaagaccttttacaagtggacaaacctcagttacccttcgagaacttcttttagggaaggactttttgaatgtaaccactgaggcaaatattttgccagaggaaacatcttcctctgcatctgatcaaccataccaaagagaaaccccacaagtgtcttcactgtgagaaaaccttctgttgctgaatattacttgtcatctgaagagtcatattagaaattcgttcagtctagagccttattctccatctgataatttatcctggagagagacccagtggttattgtgcacataggagaaccttcagctgcatctttctccttagtttacagtgcaattttatctcaggaattatttttaaaaggaggaggggacatagaaaaaatgaaatgcaagcacacatcttttcaggcttctctgccaagcctatggcgctttgtcatggatttcttagtgtatttgggggaagggaaatgtttcaaggtaaagaaccttgaccctttatgtgcttgtatgtacatttattgctatccagtgtcagaacagttagtttaggaaaagtatgcaaactttaatcgcacatcttctgtattccacaatagtacttactcttgagaagcataactttatgacaacttagggggcttgagccatgaaatactcacgtttaagtcagtaaggatacacatgttaacattcaggcttttgtcttgatgcccgtcttttggtttacgtcatcattgtagccatatggtaaatttttatttgttaaatttttaaaaattacttagctcaaaatgtcagtggtaaatttttaaattgagtaaagtgattcttctttgctcttatttaaaatcgacagcatttctagttcctttgacattccatataatttttaggattagtttgtacttatttacaaaacagtcttgttcagatttttacagaaattgagttaagtctgtggattaatctgttaagaattggtatctttactatgttgggtcttgtagttcatgagtgcaggagtaggcctcttaatttataatagttaagcattccttaaagtatttcattaatgttaaaaattttcagcgtatagatccctatgcatttttgttagaatttgcatcctagggtgcttttttgtttgtgtgtgtgtgtaatttgagtgattgtaaatggcattgatgtttgaactttgaattgcacacaatttttggtagtatacagaaatataatatttttggacattgttttgctaccctgcaaccttattgagttcacttattatttttagctatttctttcgacagaatccttggaattttctatatagaaatgtcatctgcaaatacagaccattttttatctttcatcttacctgtaatcctagcactttgagaccactaaggcaggtggatcacctgaggccaggagttcgagaccagcctggccaacatggcaaaaccctgtctactaaaaatacaaaaattagccaggcatggtggcgtgtgcctgtaatcccagctgctggggggctgaggcaggaggatcagttgaacgtgggaggcagaggttgcagtgagctgagatctcaccactgcactccagcctgggcaacagagcgagactctgtctcaacaacaacaacaaaaagtcctgaacatgattgtggaagtgtgttgctctttcaagttctatcactttttgtttgcaaagttcaaagctgtattgtttggtacatatacatgtaggtttgccaagtctttgtggtgaattgactcttctgtcattatgtgatgtcatttttttgccttttaatagtcttgtcaatactttacctgatgttctcatagtgactcctgcatattttgattaatgtttgcatggttaatatttcttcattttattttaaagcttacctgtatcattacttatgaagtcagtttctttgaacagcatatactcaggccatgctttttttattcattctgcatatgtctctcttaattggtatgttgaaatgatttacattaaaataattattgatattttagggcttaagtgtgcccttaaatgatttttgtgttcttttttattgttcctctgttatttggggttgtttactagtcttcctataggttacttcaccttttttttttttaataatttgatttgatacatatgtagtgttttttagtatagatcctccttgacttatgatggggttatgtcacaataaacccattgcaagttgaaaatactatgtcaaatatgcatttaatacacctaccctgctgaacatcatagccgatcttgccttcagaatgctcagaaaatttacattagcctgcagttgggcaaaatcatctaacacaaggcctactttataataaagttactgcaaagaattttaaataaaaattcaagtgtggtttctactgaatgcatgtcgcattcgcaccattgtaaagtcaagtagtaagtcgaaccatcctaagtcagggactgtctgtatatatctgcattttttagtgattgttctactattacagtgtaaatatataacttatgacagtttaataagttatcagcaatttagcactttacttccattaggttcctttagcttacctactaatgtaactatcttaagtaatagtaattcctcttcaaaaattgagcgctatgttgcaagatgtaatttttcttttccttttttttgagaccaagtctcactctgtcacccacgctggagtgctgtgatgcgatctcggctctctgcaacctctgcctcccgggttcaagcaattaactgcctcagcttccctagtaatggattacaggcgcccgccaccacgcctggctaatttttgtatttttagtagagacggggtttcaccatcttggccaggttggtcttgaactcttgacctcatgatccacccgcctcggccccccaaagtgctggggttacaggtgtgagccactgcacccggccacaagatgtaatttttactttatctctcacacgtattttacaaaacgtcatgagaaacattgtctcttgaccttttttttttttttttttttttaaagagacagagtctcactctgtcacccaggctggagtgcagtggcacgatcttggctcactgcaacctccgcctcctgggttcaagcgattctcctgcctcagcctcctgagtagctgggattacaggtgtgcgccgccacacccagctaattttgtatttttagtagagacggggtttcaccatgttgctcaggctggtctcaaactcctgaccttgtgatccgccaaccttggcctgtcgacctctttacccattccattgttcattcttctttcttgaaatcccaaaccttctattaacatttcttttcagttatacactgaactttactgtagcctttcttctagagtaacaaatgttctttgttttccttcctctaaagatgtctttatgtttccttcattcccaaagaatatttttgtggaatataagattcagagttggcagttgttttcttttagacttcagagatgtatctctctgttctgtacattattgtttaatataagaaacctactagcattcaaataatcattccctattttacaatgcatcagttctgtcaagcttcattcaaagtgtttttcattgtctctagtgttcagaagtttggctgtgatgtgcgtggcatggaagtttttgggtgtattctatttggcgctccctggtgcttgcccagctttttgatctgtaggattatgccttttgcaaaatttggggaactttcaactattatttcttcaaatattttttcaccccccagtcttgtcttttttagggacttcaataacatgagtggcagatcttgttttacactcccatgggtccttcaggctctcatcttttttctttttccagtctattttctgtcttgttaatattgattaatttttattgaccttccatggtcctcactgattgttttctttgtcatacctaatctgttgagtttgtgcagtgagttttcattttggttttgtattttccagttgtttaatttccattgggtgggttcttttgtacaccttctgtttctttgcttattttttaacgccaaagaaagactctcagagaatagacaactatattccaaagtcatggttctctggtggtttgtcttgacatttgaatagaaatgttaaactatctgggggaatagaaagcccacagtcttctgagttgtgctacaccaatatttctatgaacagatcttacaactgagagtgatctgcagatttttcagagtcatgttctccatggaatgtttgtaaaattccctagctctctgcactgagctgagatcgtgccactgcactccagcctgggcaacagagcgagactccatctc

SEQ ID NO: 383 - DNA, 2271 bp, Homo sapiens
cttcgcatgcagcgaatgtggaaaaggcttttatgagagtacagccctcattcaacacttcattatccatactggggagaggccctttaagtgccttgagtgtgggaaggccttcaactgcaggtcacacctcaagcagcatgagcggattcacactggtgagaagccctttgtgtgcagtcaatgtggaaaggccttcactcactattccacctatgtcctgcatgaaagagcccacactggagaaaagccttttgagtgcaaagaatgtgggaaagcctttagcattcgaaaagacctcattcgacacttcaacatccacactggagagaagccctatgagtgtttacagtgtggaaaggcttttacccgcatgtcagggctcacaaggcaccagtggattcatactggagagaagccgtatgtatgcatccaatgtgggaaagccttttgtcggaccacaaacctgattcgacactttagcatccacactggagagaagccctatgaatgcgtggagtgcgggaaggccttcaaccgcaggtcacccctcacaaggcaccagcggattcacactgcagagaagtcccacgaacccatccagagtgggaacgtttcttgtgagtgcacagatctcattcaacactccatcatccacactgagagtagcccagtgagtgcagtgaatatggaaacgccttcaattgccgctcattcctcctcactcgacatcaacggattcatagtggaagaaaccctaccattgtaacagatgtggaaagactttttacgtacacttcagtcaacatccaagaattcctattagcgaaatagttttttaatataaccactgaagaaaatctgtggtgagaggaaacatcttaccatctggtcactcatactgaagagaaactccataagtatcatctctgtgggaaaacctgttttagatcatcatttgtcatctaaacaattatgttagaaattgacacagccaagagtcttattctacatctgataattcacccatgaaagagacccagtggttactgtgcacttaggaaaaccttcagccacatctttcttattagtttacagtgaaatgttatctcagggacattcaaacaaaggaggaggagtcatagggaagagaaagaaatggaagcacagcttctttcagacttccctgacaagcccatggcaatttgtcatcccctccttattttatttgggagagggaaatgtttcagaaacaaaagggcctcatcccctttattttccctgtgtatacattcactgctgtccagtgctgtagacaaacggtttgtttgaaaacattttgtgaaagcctgctttgttccacagcattgtctccactcttgaggagcagaagcatatatctttatgagaaagatggaggcttgagttatgaaatacttttacatttaaggagataaaggatgtacatatgaatgggcacattttactgcacacttcagacgctttgacttttttaaaaaaattgtttctccgtgtgtctttaaccacccagtaccatacttttttcttgatctggatctacttgtcaatttcttctttatttttctgtaggatggagatgatattgtagctgtttgtacataatgtaatccagggagtcctaattcttccctctgattgtggtttctcagcttttttactgctctttagagagagtaaatagttcaaaattcacctcaacaattttctagaggtcaatttggaaccaaaaatgaaataagacatgtagctaaagtaagttaaaagattatgataaactcagaaaataaacacagagaaggaatctcatttttcagtcttacagaagattgtgtgaaggctgactatacataaagtgactggaattttaacaggtgaacctgcatatgtatatgcaggtagttgtcaccatggattgagtccagtcgtagtaattaatatgtttaatcagaatattttggaatttctcttttggtattctttttgtttcttttattgtttttaattgacaatgtttatggggtttggtgtgatatttcaatacatgtgtgctaagagtaatgatcaaatcagggtaattagcatatccatctcaatcatttatcatttctttgtgtttagaaacattcacagtctgcttttctagctatttgaaaatataaaatgtattattgccaattgtactcattctgcagtgccacagaacactacaacttattcaaatggaatctt

SEQ ID NO: 384 - DNA, 4317 bp, Homo sapiens
tgaaggctgagttctagagatcgggtcggctttctacgcggctctcgtggaacctagcaaagaaagacagtgaagactgcaggaccttccttcgcgcttttgttacaatccacacacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcagagttgtgtgaccttcgaggatgtgttcgtgtacttctctcgggaggagtgggaactccttgaggaggcacagagattcctgtaccgtgatgtgatgctggagaactttgcacttgtggctacactaggtttttggtgtgaagcagaacatgaggcaccttctgagcagagcgtttctgtagaaggagtgtcacaggtcaggactgctgagtcaggtcttttccagaaagcacacccatgtgagatgtgtgacccactcttgaaagacattttgcacctggctgaacaccagggatcacaccttacacagaaactgtgcacacgtgggctgtgtaggagaagattctcgttcagtgcaaacttttaccagcaccagaagcaacataatggagagaattgcttcagaggggatgatggaggggcctcatttgtgaagagctgtacagtccacatgttagggagatcctttacgtgcagggaggaagggatggacttaccagatagctctggccttttccagcaccagaccacttacaatagggtgagtccatgcagaaggactgaatgcatggagtctttcccacacagctccagtctcaggcaacaccaaggagactatgatggacagatgcttttcagttgcggtgatgaagggaaagccttcctggacacctttactcttcttgacagccagatgactcatgctgaggtgagacccttcagatgcctaccatgtggaaatgtgttcaaggagaaatcagctcttattaatcacagaaaaatccacagtggagaaatatctcatgtgtgtaaggagtgtggaaaagccttcattcacttgcaccacctaaaaatgcaccagaaatttcacactggaaaaagacactatacatgcagtgaatgtgggaaggccttcagccgcaaggacacacttgctcagcatcagagagttcacactggagaaagaccttatgactgcagtgaatgtggaaaagcctacagcagaagctcccaccttgttcagcaccagagaattcacacaggagaaaggccttataagtgcaacgaatgtgggaaagcctttagccgtaaagacacacttgttcagcaccagagatttcatactggagaaaggccttatgagtgcagtgaatgtggaaaattctttagccaaagctcccaccttattgagcactggagaattcataccggggcaaggccctatgaatgcatagaatgtggaaaattctttagccataactctagcctcattaaacatcggagagtccacacaggagcaagctcctacgtgtgcagcaaatgtgggaaggcctttggctgcaaagacacacttgttcagcaccagataattcacactggagcaaggccttatgagtgcagtgaatgtgggaaggccttcagccgtaaagacacacttgtgcaacaccaaaaaatccacactggagaaaggccttatgagtgtggtgaatgtggtaaattcttcagccatagctccaaccttattgtacaccagagaattcacactggagcaaagccttatgagtgcaatgaatgtgggaaatgctttagccacaactccagcctcattttgcaccagagagttcacacaggagcaaggccttatgtgtgcagtgaatgtgggaaggcttacattagtagctcccaccttgttcaacacaagaaagttcacactggagcaagaccttatgagtgcagtgaatgtgggaaattctttagccgcaactctggcctcattctgcaccagagggttcacactggagaaaagccttacgtatgcagcgaatgtgggaaagcctatagcagaagctcccatcttgttcgtcaccagaaagctcacactggagaaagagctcacgagtgcaacagttttggtggccctttagctgcatctcttaaacttgtttaacaccagaaaattcacacaagagaaaggccttatgaatgcagaaaatatgtcatcttgttcatcctcataggactcacaccagagcaatgctctgtgagtaccctttgtgagggaaccatcagctagcagatgagcaccgtatattcattccaccctggggagattcctgataagcaccacatatgtgggaggctttcatgaggtgtgttgcactttgtaactgtctagagctcttgatggaattatatcactgccagtgcctgtggcggaagccatcttattgctaccagctgtgtgtgtcaatcactccattttgctcagggaaggcagacttctgtgctttctttcctgttccctacaggtaatcatgaatattttcaaggacttccccccccccccacttcaccccctaccattgagggtcctcatcttttccctcatgattaggttctgagcaaacatgatctagctctcaccaaaaggacctgagctagggtctgctgggatttcctgacacgattttccatcttcatggacaatgttaactgtaaacgtgatagctgtgacttacttgtcttactgccaaatcgcccaaatttggaactgcttgtcccatgctgctctgatttatacagtgataagggcctattgtggcagtctttactcttggggattttgttactgtgtagagtggattgagaaaagaattgggttctgtcatgaagggagtagcaccttttgtgggcaccacctttatgtgcctcagaggggaccaaaggatggcagaaaactgttctcagtctagtttgacctaatttacactattgccctaggcttgctaggaaagactgaaaaaaatttttgtgcctaactttgtggcctggctgccaggatttcctgtgagcccagtgaggagggcatagttggtgcgaaaatctcctgtgcttgtggaagcaacataagttgggtcccttaactgtcacgtactccccagcactgttgagggattgctgtcttctgtacctgtacaggatcaagtccctgatatccagaaccccataggcaagtaacattgactgtaagacctctgtagggcaatgtgaaaatcatgattgctacagaagcactgagataatggagtggggatgactgtggcaaacaaaaggagattcgaacattctagaggggacatccacaagtctcggtgcagttatgatggtgtgggatgggagtgcatagaaattctcaggaccttcagacatctgtatctcctgtggccaaggccactgtcagaggaaataatctaaatgtttgtggattcctgtgtctccctgggcagttgacctgcacagacaggaacctcagcagtgacagaagagagatccagggatgggtcttctctgacccagccagcattccgagtgactgaggtggatgtggacatcattgcttaccaatttttaccaacattgaggcagggctcactctcctaaattgtagggagaggaatatggtaaagccaaaatagttgacagatctaactttcctagtggaacagtatatatagattttaatgaggaacatttatttaatagctttatggaggtatgattaacatgcaataaactgcaaatatgtaaagtgtaaaatgtgctgtttcagcatgtgtgtacacctatgaaaccaccacagtcaagatatccaacacaacaaaagattgtccctttataatcctcaatttttccttatcttgttttccacaattcacaagcaacagcaagcattttctataattttataaatgaaaccatatggtgtgtactttttagggggtggggctctggctttttcagtaaacataactattttaaggttaatccattatcttgttgcatgaatcaattgtttgctcatttgtattgctgcgtagtatttcagtatttcattgtataccacaatttttcttctttgtcaacttaattgttatggatgtttgggtaactttcagtttttggctattacaaataaacctctgaagatttgtgtgcaaa

SEQ ID NO: 385 - DNA, 2327 bp, Homo sapiens
gactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcaggttcctgtggctgcagacttgcttacagaccatgaggagggctatgtgacctttgaggatgtggctgtctacttctcccaggaggaatggagattgcttgatgacgctcagaggctcctctaccgcaatgtgatgctggagaactttacacttctggcctctctcggacttgcatcttccaagacccatgaaataacccagctggagtcatgggaggagcccttcatgcctgcttgggaagttgtgacttcagccataccgagaggttgttggcatggagccgaggctgaggaggctcctgagcagattgcttctgtaggactgctcagttcaaacattcagcaacaccagaagcagcactgtggagagaaacccttaaaaagacaacagggcagggtcccagttttgaggagttgcaaagttcacctatcagagaagtccttgcaaagcagggaggttgggaaggccctcctgatcagctcaggtgttctcaagcaccaggtgactcacacaggagagaagtcacataggagctccaaaagtagggaggcctttcatgctggaaaaaggcattacaaatgcagtgaatgtgggaaagcctttggtcagaaatatttacttgttcagcaccagagactacatgctgggaaaaagacgtatgaatgcagtgaatgtgggaagttatttagagatatgtccaacctttttatacaccaaatagttcacactggagaaaggccttacgggtgtagtaactgtggaaaatcctttagccgtaatgctcacctcattgaacaccagagagttcacactggagaaaagccttttacatgcagtgaatgtggaaaagctttcaggcataattccacacttgttcagcatcacaaaatccacactggagtaaggccttatgagtgcagtgaatgtggaaaattgtttagtttcaactccagcctcatgaaacatcagagagttcacactggagaaagaccttataagtgcagtgaatgtggaaaattctatagccacaagtccaaccttatcaaacattggcgtgttcatactggagaaaggccttacaagtgcagcgactgtgggaaattttttacccaatgctcaagcctcatgcaacatcaaaaagttcacactggagaaaagccttttaagtgcaatgaatgtgggagattctttagagagaattccaccctagttagacatcagagggttcacactggagcaaagccttatgagtgcagggaatgtgggaaattttttagccaaagctcaaccctcatgcaacatcgaaaagttcacattggagaaaagccttttaagtgcaatgaatgtgggagattgtttagagagaattccagccttgttaaacatcagagggttcacactggagcaaagccttatgagtgcagggaatgtgggaagttttttcgccacaactccagtctttttaaacatcgaaggattcacactggagaaatgcagtgattgtgtgaaatcctttagccagcgtttcaacctcattcaacaccagaaagttcacagtggaaaaaatcttgaaggtaacagatggaaatccgttagccacacctccagtctcattcaacactggacagtttacaatgtggacaatgtagtgaatatggaaaaaggtttcagccaaaggcctaaccctattcaacaccagaaagtttagaatggagaaaggccttagggtgacaggttatgtactgtctctgaatcaatatgacctcacttaaaacagaaactctgaggatggcctttatgagggagctggcaattgaacatcattcatctaaatatgcacactggaggcaagatgagaattcctgacagattgtccttcctgagaagacagccctctgccttggagctccagagagagggagccctgtattcttggctgtacccgtcgaatggagttttgatctcgctgagtttggagttgggggaggaaaggagtggtcttggttcaaatgtgactcacttttgctgttcttgtgaatgttagatcttctttaataaatatttatttcccatacacccttatgaccattaaaaaaaaaaaaaaaaaa

SEQ ID NO: 386 - DNA, 2327 bp, Homo sapiens; identical to SEQ ID NO: 385

SEQ ID NO: 387 - DNA, 2117 bp, Homo sapiens
catcggagcagaagctcggggttgctgggcggttccgaggtgacggaagcgggagggtgcgggagaagtcgctgttcgctctgcgagtggctcgccagcgaagaccccgcctgcgcccccggggacggacgaccgcggtgccagggtcccgcgacctgggaccccctcgcggctccgggtggtctacgaactgtgatggcggcggccgcggtgatgggcccggcgcagatcctctgtggttgttgaattgtaacaagagagagaactctggctgcctgagagggcatgactctagtcacagcaggaggggcttggacaggccctggttgttggcatgaagtgaaggatgaagagtcatcttctgaacagagcatttctatagcagtgtcacatgttaatacttccaaggcaggtttgcccgcacagacggctctcccttgtgacatatgtggccccatcttgaaagatattttgcacctggatgaacaccagggtacacaccatggactgaaacttcacacatgtggggcatgtgggagacaattctggttcagtgcaaccttcatcagtaccagaagtgttacagtatagagcaacccttaagaagggataaaagtgaggcctcaattgtgaagaactgcacagttagcaaagaacctcatccgtcagagaagccctttacgtgtaaggaggagcagaaaaacttccaggctactttgggtggctgccaacaaaaggccatccacagtaagaggaagacacacaggagcactgagagtggggatgcatttcatggtgaacaaatgcattacaagtgcagtgaatgtgggaaagctttcagccgcaaagacacacttgtccagcaccagagaattcatagtggagagaagccttatgagtgcagcgaatgtgggaaagccttcagccgcaaagctacacttgtccagcatcagagaatccatactggagaaaggccttatgaatgcagcgaatgtggaaaaaccttcagtcgaaaagacaaccttactcagcacaagagaatccacactggagaaatgccttataagtgcaatgaatgtgggaaatattttagccatcactccaatctaattgtacaccagagagttcacaatggagcaaggccttataagtgcagtgattgtgggaaagtcttcagacacaaatctacacttgttcagcatgagagtattcacactggagaaaatccttatgattgcagtgattgtgggaaatcctttggccacaaatacaccctcattaaacatcagcgaattcacactgagtcaaagccgtttgagtgcattgaatgcgggaaattctttagtcgaagttctgactatattgcacaccagagggttcacactggtgaaaggccttttgtgtgcagtaaatgtgggaaagactttatcagaacctcccaccttgttcgacaccaaagagttcacactggagaaaggccatatgagtgcagtgaatgtgggaaggcctacagcttaagctcccacctcaatcggcaccagaaagttcacactgcaggcaggctttaggagtgctttgaatacaacaggactcatcaatcagatgttgaatttcatgtatctgaacattgacacaaaggagataccttatggtgccaggtacgtgggaaccttctagggatatgttgcactttctgacttgctcaggttttttgccagagttatgtcactgtcaatccatgtggccgaaaccatcttaactctaccagctaagataccccagcattgggaaggcagggtttgtattgtcagtccctggagaaaatcatgaaatgcctgagttcattgggggtcctcattcccttctgtatgacaggtataggtatggatctgacccatttttagccaagagggtctgagctgtatctgctggtggcttatacaaaaagtttactttcttcatggatattcttggtctcacatacttgtaatcaagtttttccagcctccaagtcacctggcctgggaaagtacttgcctcatgttgctctggtttgtgataataaaggctttacagtttaagccacagggaaagaaaaaaaaaaaaaaaaactttag

SEQ ID NO: 388 - DNA, 2469 bp, Homo sapiens
cggaggtccgttctgtctgtcagccgctttggtacgctgcatcgggatcgaagtgacggaccgtgaaggcgcgagagtcaggtctgagggtcgggggcagagccgcccgcgaggccggcctggggatagcgatgctcgggttccccccgggtcgcccgcagctcccggtccagctccgcccacagactcggatggcgaccgcactgagggacccggcttcggttcccatagctacagaggtgcttttcaaacttacacagggaagtgtgacctttgaagatgtggccgtgtacttctcctgggaggaatgggatctccttgatgaggctcagaaacacctgtacttcgatgtgatgctggagaactttgcacttacgtcctccctgggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttcctttgagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaagctaaaaaaaaaaaaaaaaaa

SEQ ID NO: 389 - DNA, 2427 bp, Homo sapiens
cggaggtccgttctgtctgtcagccgctttggtacgctgcatcgggatcgaagtgacggaccgtgaaggcgcgagagtcaggtctgagggtcgggggcagagccgcccgcgaggccggcctggggatagcgatgctcgggttccccccgggtcgcccgcagctcccggtccagctccgcccacagactcggatggcgaccgcactgagggacccggcttcgggaagtgtgacctttgaagatgtggccgtgtacttctcctgggaggaatgggatctccttgatgaggctcagaaacacctgtacttcgatgtgatgctggagaactttgcacttacgtcctccctgggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttcctttgagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaagctaaaaaaaaaaaaaaa

SEQ ID NO: 390 - DNA, 993 bp, Homo sapiens
attccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtgaaaaaaaaaa

SEQ ID NO: 391 - DNA, 1234 bp, Homo sapiens
attccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggtgagatccagatccgaccactagatcatccttataccgacggggaaacggaggccagagagggcgtgggcgcttgcaccacttccgtcccatccttgcgggtacctggctatgcgggggtgcctaaggagcctggaaaaagcgctcccccgtcgtgcttcctggggaagggggcgttcgctgcgctcggagcggcgtcccttccaacccgccggtctcatttcttctcgttttcacaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtgaaaaaaaaaaaa

SEQ ID NO: 392 - DNA, 417 bp, Homo sapiens
gtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgttactcttga

SEQ ID NO: 393 - DNA, 2535 bp, Homo sapiens
ctgggggcggggcaggggcaggtgtagcctctgtgcctcgttgtcccctggcgctacccggacatctctcagggtgccggcaccatgaagatctggacttcggagcacgtctttgaccacccgtgggaaactgttacaacagctgcaatgcagaaatacccaaaccctatgaacccaagtgtggttggagttgatgtgttggacagacatatagatccctctggaaagttgcacagccacagacttctcagcacagagtggggactgccttccattgtgaagtctcttattggtgcagcaagaacgaaaacatatgtgcaagaacattctgtagttgatcctgtagagaaaacaatggaacttaaatctactaatatttcatttacaaacatggtttcagtagatgagagacttatatacaaaccacatcctcaggatccagaaaaaactgttttgacacaagaagccataattaccgtgaaaggagttagcctcagcagttaccttgaaggactgatggcaagtacgatatcctcaaatgctagtaaaggccgagaagcaatggaatgggtaatacataaattaaatgctgagattgaagaactgacagcctcagcaagaggaaccataaggactccaatggcagcagcagcgttttgcagagaagtgatcgtgacagttggtagacaacatcgggtactccaggtctctccaaactgactatatatttatttgttattttaaaaatacaactatattttgggtagttttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcctatagacgcccattgccctgctgctgtacacttcagcagcttgcacaagggagctcacttaaaaggagaaattgtgtagttttaaaatatattttgtgtaaaataccttactatgctataaaccaccattaaaaaccagtgttttgatttggtacttaaatatttttggagtgaaaattatcactaaagtaacatgactccaacaaaagtatggtttcattataaaagagtactgtattgatttgcccaagttttgtaacttagtaaaggtattaacttccttggatttgtactttgtgatttagtatgctgtatcgtgggctggttatgttaactgaaaaaaataaagtcattacctgagttttgcagtgctctaacttaaacagaagaacagctgttcacatcttttagcattttacatttgcctaacttaaaaattgccatgtgtcaaaatcatggttttgtaattgctaaggcatgatatgtcaggttatttgaatataattactttttgaagtaattgtgaccacaaaacatcttttttacatgaaggagctgtgtatcatttgaaattactcaaatgatgtcttgctctgaggcataaatcccaggtacttagtgtttttaataatatggtgccactgcaggatttgggggcggtggggaagaacaagcataatggtagggggaggcttggcctgaaactaaccactgagtgaattgcactgcaggttttacttaacgggaattccttatttgggatgtcaagagggcagctgcaaactgaaaaacaatccagtaaatgtactttgttttatgtattgtagcaggcaattaactactaaataatagctttgacatttgcaattgttgcatagagactatttttgctagaagatgattagctcttgcctttattttacagtgcttagtgtgataaacttctagtcatgtttcctatccaagagaccagttaatatatgtacataaaccacagaaatagtataacacactatttttaaattatcgttttcctacttaaattttgtttagcttaagacttcttaggacatttgtaaaagcaggttaaatttaataaggtttctgatttttttttgtaaccggagatagtttttacaagtgaaataacatttcagctaaataaaacatcgctaaataattgatatttgatgaaaatctgctttgtataatttctgtaaattatccttgttctgaaaaaggtgtaatgccctaatatttttaaatccttatcctttgattttttaaaaactgacctattgataaaactataaattttcattttccagtgcagttagttacctttttaaacataaatgcacaacaagcaaatgaatttaagagaactaaactggaataagtgttcataaatgaaacccttggactatttaataaagttgaaatgtgaattaaggaaaacttttgttaataaaaactttcttttaaaaaaaa

SEQ ID NO: 394 - DNA, 3481 bp, Homo sapiens
aagtaacgccgcggaccgggaaagtgggaggggccgctcccggaacgcagccttcttgtaagaacctccaaggaagcaagaagaaaaaagaggcgctaccctgcgctcccgggaggcctctgaaagcttccactagagaaaaactccccactcttacaatttctttaaccgcaagaagcggaggacctggacaaggactcgaggagcaaggtggcgaaccaagggtagggcgcaccgggcccgagaggtcccccgcaggttgcagatacggtggactctctgcggcttctgagcacggagggagctgtcgcggggtcgggaggtcgtctctcatccctgcctcatcttccgacggccggcggggccatgtccagaggcccgagctccgcggtcctgcctagcgccctgggatcccggaagctcggcccccggagcctcagctgcctgtcggacctggacggcggcgtggccctggagccgcgggcctgtaggccccctgggagcccgggccgcgcgccgccgccaacgccagcgccgtcgggctgcgacccccgcctgcggcccatcatcctgcggcgggcgcgctcactgcccagctcccccgagcgccgccagaaggccgcgggcgcgccgggcgctgcgtgtcggccgggctgcagccagaagctccgcgtgcgcttcgccgacgccctgggcttggagctggcacaggtcaaggtgttcaacgcgggagacgacccgtccgtgccgctgcacgtgctgtcgcggctcgcaatcaactcggacctgtgctgcagcagccaggacctggagttcaccctgcattgcctggtgcccgatttcccgccgcccgtcgaggccgccgactttggcgagcgcctgcagcggcagctcgtgtgcctggagcgtgtcacttgctcggaccttggcatcagcggtacggtgcgcgtgtgcaacgtggccttcgagaagcaggtggctgtgcgctacactttctcgggctggcgcagtacccacgaggcggtggcgcggtggcgcgggcccgcaggccccgagggcacggaggacgttttcaccttcggctttccagtaccgcccttcctgctggagctcggctcccgcgtgcacttcgcggtgcgctaccaagtggcgggtgccgagtactgggacaacaacgaccaccgagactacagcctcacatgtcgcaaccacgcgctgcacatgcctcgcggggagtgcgaagagagctggatccacttcatctgagccgcgcggggaccggccacctggagcctccacacctaagctgcgcctcctgtcatttccctgctgggctctcacatctatctggttgttcttcaccaccctccaagtcctctgacctaattttctgctgcaaggtcccctggcagtggcccatcctgtcttctacttgaaacgtctgagtcacttggtctaaaaagtagcctcaggtggccagaaggccgagttgtgtaatgagttggggcagggtggtggggtaggtgcatgggagggtgggccctctggggaggcccaagcagcttgttttgcaaaggcccaagtcctcctgctaggaaaagcttttgcatgtgtcctgaatgtgtctctgtaaacatagctgttatttattattgtgatgttgggacctttagcccatagcggatgcctcctcaggaatattctcgatttaataagctaaaaaaaaaaagttctgtgtttgtgcccacagtaaacagaatgtacagtgtgacccacatcgtggtccctccaggcattcctgccccaggataaggaaaacctgagcccacatctgattgccaacggctgtagccttctaacagtgggaaactattaataggcaagaaatttctgctttatcagtcatcacacaaccattcctgggcattgagactgtcctggttaggctgtgtgtctcctacattaacagctggggaggagggaaaagcttcagacttttaaactagcaaaacagttatttctctgcattcacaattctgatttcatgtatttctctgtacatgtttgatcattatcaggccattctgtttaagtttgaaactaagcattttaagaagtcttgcctcagttatttcagttttcaggtgactagagaatttcaggcaacagtgccctttgcaattacctttttgatgattaaggtgactatttttatttcttgttaagcatcagaagatgtcagcattcatcttttgggagtccagttacaaggtggaactagaaggtgttttcagcaatagccagagcactggaggaaaaataattgacaaatatttatacttttaaattgttttgaactgtatttacatacatcatgttttatcaggtacccaccaactttatactttctgccttcagatagagtttctaacattttctagtttgtcagttttaaaatataaaattcttttatgtttttaaaccgtcaaccaagaagtcaagaccactgtcccctgctgagttaggcaatcacttaaaactccaaagaactccaggctgaggagttcttttggtgctgaacagtggtctgacaacaggtgctagaattaaggtgtgggaaaaaaaaaaaaacagccaggaaggacaagatctccaatttgtgaagcttatgatacagctgaaaccagtctgatcaattttatgctacctgtcaccaagaaattaactctaaatttttgaatgcttgttggcatctgtcaaatcaatactgaaaggatgcatttcggcttttaaccagtttggttctgatcattgcaacctctgtgcttttataattcaaagaacaaggatagctttcttcggtatcttttaatataagaacactgaattttggcttgaaatattgtgactaaattgcacaatctctggctattagcactgttcactacattaacatgcaagagagagagaagccttgttacatttcctgctatttaacaaactgtccaattaggtcagcaagcctgttagggccttcactgctacgcccctggccccaaaacagagagcaagacagttgtccagagaatttagatatgagttaagagctgccagatttattttaaggcatgtagagaatctcataatctatgtgaaagtcacttgccaaaaaggttttggttatgaaagtgaatgttatatatttaatattaagtgaacctcccgtgccttttaaaaaataccaacattatgaaatttaaaagcttaaatatatttgcctagttgataaagaggctgtggaacaactgaaggagaactttcagaccctaaaacagttatattacttagatgttaaaattttctagtgggctgtgcaattgctgggttgtccccccaaacatattttaatatgttatttaaaatgattttacccaagcctaagtattaaagtatatgtgcaaaaacaaaaaaaaaaaaaaaa

SEQ ID NO: 395 - DNA, 4641 bp, Homo sapiens
atggcggcgggctcggatctgctggacgaggtcttcttcaacagcgaggtggacgagaaagtggtgagcgacctggtgggctcgctggagtcgcagctggcggccagcgcggcccaccaccaccacctcgcgccgcgcacgcccgaggtgcgggccgcggccgccggcgcgctcgggaaccatgttgtgagcggcagcccggccggagccgcgggcgcagggccggccgcccccgccgagggcgcgcccggagcggcgccggagccgccccccgcaggtagagcgcggccggggggcggggggccgcagcgcccgggccccccctcaccgcgccgcccccttgtccccgcagggcccgcgccgcccgccgcgaagctgaggccgccgcccgagggcagcgcgggggcctgcgccccggtgcccgccgccgccgccgtcgccgcggggcccgagcccgcccccgccggccccgccaagcccgccggccccgccgcgctggccgcccgcgccggccccggccccgggcccggccccggccccggccccggccctggcaagcccgccggccccggcgccgcgcaaactttgaatgggagcgccgcgctgctgaactcgcaccacgccgccgcacctgctgtcagcctggtcaacaacgggcccgccgcgctgctgccgctgcccaagcccgccgcccccggcactgtcatccagacgccccccttcgtgggcgccgccgcgccccccgcgcccgccgcgccctcgccccccgccgcccccgcgcccgccgcccccgccgccgccccgcccccgccaccccccgcgcccgccaccctggcccggccgcccggccaccccgccggacccccgaccgccgcgcccgccgtgccgccccccgccgccgcccagaacgggggcagcgccggggcagcccccgcccccgccccggccgccgggggccccgctggggtcagcggccagcccgggcccggcgcggcggctgcggcgccggcgccgggggtcaaggccgagtcgcccaagagggtggtgcaggcggcgcccccggcggcgcagaccctggcggccagcggcccggccagcacggcggccagcatggtcatcgggccaactatgcaaggggcgctgcccagcccggccgccgtcccgccgcccgcccccgggacccccaccgggctgcccaaaggcgcggccggcgcagtgacccagagcctgtcccggacgcccacggccaccaccagcgggattcgggccaccctgacgcccaccgtgctggccccccgcttgccgcagccgcctcagaacccgaccaacatccagaacttccagctgcccccaggaatggtcctcgtccgaagtgagaatgggcagttgttaatgattcctcagcaggccttggcccagatgcaggcgcaggcccatgcccagcctcagaccaccatggcgcctcgccctgccacccccacaagtgcccctcccgtccagatctccaccgtacaggcacctggaacacctatcattgcacggcaggtgaccccaactaccataattaagcaagtgtctcaggcccagacaacggtgcagcccagtgcaaccctgcagcgctcgcccggcgtccagcctcagctcgttctgggtggcgctgcccagacggcttcacttgggacggcgacggctgttcagacggggactcctcagcgcacggtaccaggggcgaccaccacttcctcagctgccacggaaactatggaaaacgtgaagaaatgtaaaaatttcctatctacgttaataaaactggcttcatctggcaagcagtctacagagacagcagctaatgtgaaagagctcgtgcagaatttactggatggaaaaatagaagcagaagatttcacaagcaggttataccgagaacttaattcttcacctcaaccttaccttgtgcctttcctgaagaggagcttacccgccttgagacagctgacccccgactccgcggccttcatccagcagagccagcagcagccgccaccgcccacctcgcaggccaccactgcgctcacggccgtggtgctgagtagctcggtccagcgcacggccgggaagacggcggccaccgtgaccagtgccctccagccccctgtgctcagcctcacgcagcccacgcaggtcggcgtcggcaagcaggggcaacccacaccgctggtcatccagcagcctccgaagccaggagccctgatccggcccccgcaggtgacgttgacgcagacacccatggtcgccctgcggcagcctcacaaccggatcatgctcaccacgcctcagcagatccagctgaacccactgcagccagtccctgtggtgaaacccgccgtgttacctggaaccaaagccctttctgctgtctcggcacaagcagctgctgcacagaaaaataaactcaaggagcctgggggaggttcgtttcgggacgatgatgacattaatgatgttgcatcgatggctggagtaaacttgtcagaagaaagtgcaagaatattagccacgaactctgaattggtgggcacgctaacgcggtcctgtaaagatgaaaccttcctcctccaagcgcctttgcagagaagaatattagaaataggtaaaaaacatggtataacggaattacatccagatgtagtaagttatgtatcacatgccacgcaacaaaggctacagaatcttgtagagaaaatatcagaaacagctcagcagaagaacttttcttacaaggatgacgacagatatgagcaggcgagtgacgtccgggcacagctcaagttttttgaacagcttgatcaaatcgaaaagcagaggaaggatgagcaggagcgggagatcctgatgagggcagcaaagtctcggtcaagacaagaagatccagaacagttaaggctgaaacagaaggcaaaggagatgcagcaacaggaactggcacaaatgagacagcgggacgccaacctcacagcactagcagcgatcgggcccaggaaaaagaggaaagtggactgtccggggccgggctcaggagcagaggggtcgggccccggctcagtggtcccaggcagctcgggtgtcggaacccccagacagttcacgcgacaaagaatcacgcgggtcaacctcagggacctcatattttgtttagaaaatgaacgtgagacaagccattcactgctgctctacaaagcattccttaagtgacacaggaggacgcctggggactttttatatatttgcagattacgcctttttgtaacgagcaaatgggatattgtttaaaaaacagccacctctttacaatggaacagttttatattcctgtttctaaatcagctcttcagtgtgaaagaaaacacgtttctgtaacagagagaacacaaaggcctgtggatactcttaaaggacaattaaatcttaactcatcttgattgagtggccttcctgccaaacaagccatatataaagactgatggaatcgttagcaaataattagctgccctctgtcaactcatagcagtttctgcattatttgtgcattttggtttagttctacctaacttactatgtaggtgtatgtctacagccgatgacctcatttcgtttattttatttttgtaatagtcagttggcaaagcaaactgattttttagactatttatcttccttcccttcccctcccaccccgctctcctctctgccccctgccctcccctcccctcccttcccctccactccgctgagaatcctggaggaatacacaattcatcgttgcacccccacctcagagtgtaatcgcatttctgcttggtagaggccgagcccagcaaaggtggctccttctgaatgtgtggtcagcatctgtacaaatgcattttatttgctatagtttgtaaagctgtaaagttaaaagagatgaaaaccttttcagcataaatatattttacttgcactgtgttttttagctaaaagtgaaaacctagattaaataaaatcaaagttgagaagaatcatcaaaagactgtttctcggtgtgaatcaagtgttgaaaaatggttggtgtattttgtcagtaattgtacataacttttggcacatgacatagaaatggctatgtaaactataattattttgctaagagactgtatgcaagccttgggccgactttacagacgtccagagcaaagccccttctttgtacctatttttttattacaaatatactaattggttctttctattttcagaggttattgtatgaaattgtctattgatagtacttttatgactgtaaatactctggctttctccgtgtgaattctcacattagactttaattcgagcgcgtgtgaactgaacgctgatcagtattttttatcaacacctgagaactgttacaccttttattttgtcttttaggaaatccctgtctttccattttttcatgtaaattttgcacagttacttgttcatatgtaaatattttactttcagaaatgaagtttttaattgctattgttttatataggattgaaagaaaattaactcctttattaaaaacaaatttatctgtaaaaaaaaaaaaaaaaaaaa

SEQ ID NO: 396 - DNA, 3754 bp, Homo sapiens
agcgcagccggagtatccacctcgatgaccacgggctgagccccgcgccgccaccatgtccgtggccttcgcgtctgcccggccaagaggcaaaggggaggttacgcagcaaaccatccagaagatgctggacgagaaccaccacctgatccagtgcatcctggagtaccagagcaagggcaagacggccgagtgcacgcagtaccagcagatcctgcaccggaacctggtatacctggccacgatcgcagactccaaccagaacatgcagtccctgcttcctgccccgcccacgcagaacatgaacctgggccctggagccctgactcagagcggctccagccagggcctgcactctcagggcagcctgagtgacgccatcagcacgggcctgccaccctcctccctcctgcagggccagattggcaacgggccgagccacgtgtccatgcagcagacggcgcctaacacgctgcccaccacctccatgagcatctctgggcccggctacagccacgcgggacccgcctcgcagggcgtccccatgcaggggcaaggcaccatcggcaactacgtgtctcggaccaacatcaacatgcagtccaacccagtctccatgatgcagcagcaggcggccacgtcgcactacagctcggcgcagggcggcagccagcactaccagggccagtcgtccatcgccatgatggggcagggcagccaggggagcagcatgatggggcagcggcccatggcgccctaccggccctcccagcaaggctcttcccagcagtacctgggccaggaggagtactatggcgagcagtacagccacagccagggcgccgcggagcccatgggccagcagtactaccccgacggccatggcgattacgcctaccagcagtcatcctacacggagcagagctacgaccggtccttcgaggagtccacgcagcactactatgaggggggaaactcccagtacagccagcagcaggccgggtaccagcagggtgccgcgcagcagcagacgtactcccagcagcagtaccccagccagcagagctaccccgggcagcagcagggctacgggtctgcccagggagccccgtcacagtaccccggctaccagcaaggccaaggccagcagtacggaagctaccgagcaccgcagacagcgccgtctgcccagcagcagcggccctacggctatgaacagggccagtatggaaattaccagcagtaagggacacacattctggctggagcccttgtggtagcgtgttcatccaggggccggatgggctggcggcagctctggtgaattgtgacatgttggttacctgttcgcccagtgccacgtctgcatgtgaagcgtgctcatttcatgctgggacctacttgctcagatctccaagcaagcatttcttttcttttagggatgtctgaaagtcacatccagttacattactgtgttctttctaatgaaaagtaaaggttttatatagagaaacttgagtaatttttacatttctaagacattaaatcccatttaaattctgtgtgaacattaaagacagcacacttgcaaaagtatggtcaaaggaaaaaaatcccacatttcaattaacaagtagcatggacatttgatcaacctttagttggaataataatattcatatttgctatgaatccttttaaaaaaatctttggataaatgctgacagatttccaagaactaccaagaaaatacaagagatatccaatgcttgatatatgaggcctagtaataacgatatttctctttaattgatgttttgttttaaaagttaaaagtaattcttggcgtggtggttcacgcctgtaatcccagcactttgggaggccgaagcgggcggatcacctgaggtcgggagttcgagaccagcctgaccaacatggagaaaccccgtccctactaaaaatacaaaattagccaggtatggtggtgcatacctgtaatcccagctactcgggaacctgaggcaggagaatggcttgaacccaggagacagaggttgtggtggggcaagatcgcaccattgcacccgagcctaggcaacaagagtgaaattccgtctcaaaaaaataaataaataaataaataaataagttaaaattaattctttatccagagtcgggtgctttagaatttataagtcacttatgtgttttgcttgaattaattctgacagcccctatgaggaaatctggaggcaggtaacagttcccattttagagatgaagaactgaggcacagattaaaggacttgcctgtgttgaataccagtcctgttctaggacattctcccctctcctaggagacggatgtcacgcacaaatggggagagaagtgtttattttgtaggcactaagggtttctaaaacccttaacactggtaagggctcaaaaataaacgtatgtgttcatattcgatcaccgaaatgagagttcttaattgctaattgacaaacgcgttagcaatttcagttagggagtcatctcccttgattgtgttcttttcctgtcaattttcatagacctaatttgcaaactcaatcggggactaaaatttcccactgaaaatgttaaacattttagataactgtgaagatagtttatttttattccttgccaatctgggaatatgccttttttgtgtgtttgtgtgtttttttaagtgctgtattaataatactttctgaaagaaaaggacacttaccccaaaacttcaatctgaaatgtcttacattaagaatatcttgaatgttgtgtatatattttaaaaagcactttgcaaaatagtttgtacatttatttcctaatttatacatgatttttggtgttaatatatttaatgattaataacagaatgtttatttaatgtgctgtccatttttatgtaatattatggggaaagtgatgccagcagttccttttcattattctatcttctgtcatatgaatgttgagcaaagcttaggccaacatgaattgtttgtgaagtgtggttgatggtgctttgtttttttctgactacttctatggaaggccagtgaagaagcaaaggaagacatgaaaattgacgctcattcttcttcctattgttccctgacatccagcaaattgtgaatttgaaaaatgatggccagttttcagaagtgctgacaaattcatattggtatgcaaaagctcatcacccattaaggtttgttgttgaatcaacagtactcagcatattaaaacagtacatcagaactcatgccaacagtctttatgatgggattaaggtggacaagatctcctaagatctgtgaatgggattaaggtggacaagatctcctaagatctgaaaagaaaccttaatacgctcatatggttggagtgttaagtgaacctctgattttgtcagggtttttctacgtgtaggcgtgaatagggggcaccccttcaaaactgtacaaagaagacgactgttttccatttccatttaaacatttttagccacttcatttctatttattgaacaggtcaaatttgtcttgttatttgtgagtacagtacatttaaaaaacatccttatcggttatttttttttcagtcggagtttgacgtataaattgtttatgcttttggtgtaatctcttaataaactggttcttcaaaaatcatcctataaagtgagttttcatgaagaaaaaaaaaaaaaaaaaa

SEQ ID NO: 397 - DNA, 4566 bp, Homo sapiens
agcgcagccggagtatccacctcgatgaccacgggctgagccccgcgccgccaccatgtccgtggccttcgcgtctgcccggccaagaggcaaaggggaggttacgcagcaaaccatccagaagatgctggacgagaaccaccacctgatccagtgcatcctggagtaccagagcaagggcaagacggccgagtgcacgcagtaccagcagatcctgcaccggaacctggtatacctggccacgatcgcagactccaaccagaacatgcagtccctgcttcctgccccgcccacgcagaacatgaacctgggccctggagccctgactcagagcggctccagccagggcctgcactctcagggcagcctgagtgacgccatcagcacgggcctgccaccctcctccctcctgcagggccagattggcaacgggccgagccacgtgtccatgcagcagacggcgcctaacacgctgcccaccacctccatgagcatctctgggcccggctacagccacgcgggacccgcctcgcagggcgtccccatgcaggggcaaggcaccatcggcaactacgtgtctcggaccaacatcaacatgcagtccaacccagtctccatgatgcagcagcaggcggccacgtcgcactacagctcggcgcagggcggcagccagcactaccagggccagtcgtccatcgccatgatggggcagggcagccaggggagcagcatgatggggcagcggcccatggcgccctaccggccctcccagcaaggctcttcccagcagtacctgggccaggaggagtactatggcgagcagtacagccacagccagggcgccgcggagcccatgggccagcagtactaccccgacggccatggcgattacgcctaccagcagtcatcctacacggagcagagctacgaccggtccttcgaggagtccacgcagcactactatgaggggggaaactcccagtacagccagcagcaggccgggtaccagcagggtgccgcgcagcagcagacgtactcccagcagcagtaccccagccagcagagctaccccgggcagcagcagggctacgggtctgcccagggagccccgtcacagtaccccggctaccagcaaggccaaggccagcagtacggaagctaccgagcaccgcagacagcgccgtctgcccagcagcagcggccctacggctatgaacagggccagtatggaaattaccagcagtaagggacacacattctggctggagcccttgtggtagcgtgttcatccaggggccggatgggctggcggcagctctggtgaattgtgacatgttggttacctgttcgcccagtgccacgtctgcatgtgaagcgtgctcatttcatgctgggtatgacgccgagcgcacaccactggcgtgagacagcgcttggtggtgtgatacttttggtgctgtgtatagtattgtatgtcggtacacggagaggtatcctttttttgtcccccgcccccttctcaatgtttctagctagctttgggggtcattttgtcatcagagcattctgtgcccagggacaggacagatctcgaggacaccacagtccacctgttcccgtcaacagacgttaggtctcattttcctcctcatgcagtgttgtagtgtgggttgtcaacttttctttaactggctacgccacagctggacacacatgcagcccctggagggcagcctcttcctgtgcctcgatggggtgggtgggagggcatcttctgtgcgttgggtcagtttctgttacgtaacgaaaaggataaacatctcccacgggagaggccacagatggccacttccagagcttgcccattgcctgtctctcgccaattccgtttatccaaaaaggtacatgtttttgtattaaaaagtaaacagggatcagtgactgtattccaaataaatatgaatccctaagggccgtggacaaattgcctaacccagggccagcggtattgctgaaggaaaggggcagctctctgggaagtgggccctcagagattactctggctttgacccttgtttagctgatggtcatttctgggattggaatatttaataagcccaattctaagttgataggtaattttaaatattcaaaccaaatcttcccaacagttggcaagttgtttattttatattatttcttccaggacctacttgctcagatctccaagcaagcatttcttttcttttagggatgtctgaaagtcacatccagttacattactgtgttctttctaatgaaaagtaaaggttttatatagagaaacttgagtaatttttacatttctaagacattaaatcccatttaaattctgtgtgaacattaaagacagcacacttgcaaaagtatggtcaaaggaaaaaaatcccacatttcaattaacaagtagcatggacatttgatcaacctttagttggaataataatattcatatttgctatgaatccttttaaaaaaatctttggataaatgctgacagatttccaagaactaccaagaaaatacaagagatatccaatgcttgatatatgaggcctagtaataacgatatttctctttaattgatgttttgttttaaaagttaaaagtaattcttggcgtggtggttcacgcctgtaatcccagcactttgggaggccgaagcgggcggatcacctgaggtcgggagttcgagaccagcctgaccaacatggagaaaccccgtccctactaaaaatacaaaattagccaggtatggtggtgcatacctgtaatcccagctactcgggaacctgaggcaggagaatggcttgaacccaggagacagaggttgtggtggggcaagatcgcaccattgcacccgagcctaggcaacaagagtgaaattccgtctcaaaaaaataaataaataaataaataaataagttaaaattaattctttatccagagtcgggtgctttagaatttataagtcacttatgtgttttgcttgaattaattctgacagcccctatgaggaaatctggaggcaggtaacagttcccattttagagatgaagaactgaggcacagattaaaggacttgcctgtgttgaataccagtcctgttctaggacattctcccctctcctaggagacggatgtcacgcacaaatggggagagaagtgtttattttgtaggcactaagggtttctaaaacccttaacactggtaagggctcaaaaataaacgtatgtgttcatattcgatcaccgaaatgagagttcttaattgctaattgacaaacgcgttagcaatttcagttagggagtcatctcccttgattgtgttcttttcctgtcaattttcatagacctaatttgcaaactcaatcggggactaaaatttcccactgaaaatgttaaacattttagataactgtgaagatagtttatttttattccttgccaatctgggaatatgccttttttgtgtgtttgtgtgtttttttaagtgctgtattaataatactttctgaaagaaaaggacacttaccccaaaacttcaatctgaaatgtcttacattaagaatatcttgaatgttgtgtatatattttaaaaagcactttgcaaaatagtttgtacatttatttcctaatttatacatgatttttggtgttaatatatttaatgattaataacagaatgtttatttaatgtgctgtccatttttatgtaatattatggggaaagtgatgccagcagttccttttcattattctatcttctgtcatatgaatgttgagcaaagcttaggccaacatgaattgtttgtgaagtgtggttgatggtgctttgtttttttctgactacttctatggaaggccagtgaagaagcaaaggaagacatgaaaattgacgctcattcttcttcctattgttccctgacatccagcaaattgtgaatttgaaaaatgatggccagttttcagaagtgctgacaaattcatattggtatgcaaaagctcatcacccattaaggtttgttgttgaatcaacagtactcagcatattaaaacagtacatcagaactcatgccaacagtctttatgatgggattaaggtggacaagatctcctaagatctgtgaatgggattaaggtggacaagatctcctaagatctgaaaagaaaccttaatacgctcatatggttggagtgttaagtgaacctctgattttgtcagggtttttctacgtgtaggcgtgaatagggggcaccccttcaaaactgtacaaagaagacgactgttttccatttccatttaaacatttttagccacttcatttctatttattgaacaggtcaaatttgtcttgttatttgtgagtacagtacatttaaaaaacatccttatcggttatttttttttcagtcggagtttgacgtataaattgtttatgcttttggtgtaatctcttaataaactggttcttcaaaaatcatcctataaagtgagttttcatgaagaaaaaaaaaaaaaaaaaa

SEQ ID NO: 398 - DNA, 984 bp, Homo sapiens
cggcgccgagggtggggcgcgggcgtagtggcgccgggagtcgcgggtgcgcgcgggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggtcggggtgccaagtcagtgcgcgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtattttt

SEQ ID NO: 399 - DNA, 1069 bp, Homo sapiens
cggcgccgagggtggggcgcgggcgtagtggcgccgggagtcgcgggtgcgcgcgggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcaggtgggtgcctgcccgcttgcatgctcacctctggcagcagggcagtcacggctccgccatggagggtcctgccatgtcacttcagcgttatacgcagagcaatgggcgcaggccgtttggcatctctgccctcatcgtgggtttcgactttgatggcactcctaggctctatcagactgacccctcgggcacataccatgcctggaaggccaatgccataggtcggggtgccaagtcagtgcgcgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtattttt

SEQ ID NO: 400 - DNA, 3935 bp, Homo sapiens
agtgggtcgcgggcctacggggcgggggcggggcggcagtgagctcggccggcaaccgagggacccgcgtccagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacagaggcaaatcagaaagtcacgggaatgattgacttagacaccagcaaaaataataggattgggaaaactggggagaggccctctcaagagaacggaattcagaaacacaggacatcgctgccggctcccatgttcagcagaagcgacttcagcgtgtggaccatcctgaagaagtgtgttggcctggagctgtccaagatcacgatgccaatcgccttcaacgagcctctgagcttcttgcagcggatcacggagtacatggagcacgtgtacctcatccacagggcctcctgccagccccagcccctggagaggatgcagtctgtggctgcttttgctgtttcggctgtggcttcccagtgggagaggaccggcaaaccatttaatccactcttgggagaaacgtatgaattaatcagggaagatttaggattcagatttatatcggaacaggtcagtcaccacccccccatcagtgcgttccactcggaaggtctcaaccatgacttcctgttccatggctccatctaccccaagctcaagttctggggcaaaagcgtggaggcggagccccgaggcaccatcaccctggagctgctcaaacataatgaagcctacacctggaccaaccccacctgctgcgtccacaacgtcatcatcgggaagctgtggatagagcagtatgggacagtggagattttaaaccacagaactggacataagtgtgtgcttcactttaaaccgtgtggattatttggaaaagaacttcacaaggtggaaggacacattcaagacaaaaacaaaaagaagctctttatgatctatggcaaatggacggaatgtttgtggggcatagatcctgtttcgtatgaatccttcaagaagcaggagaggagaggtgaccacctgagaaaggccaagctggatgaagactccgggaaggctgacagcgacgtggctgacgacgtgcctgtggcccaggagaccgtgcaggtcattcctggcagcaagctgctctggaggatcaacacccggccccccaactctgcccagatgtataatttcaccagtttcactgtgagcctcaacgagctggagacaggcatggagaagaccctgccacccacggactgccgcctgcgccctgacatccgcggcatggagaatggcaacatggatctggccagccaggagaaggagcggctggaggagaagcagagagaagcacggagggagcgggccaaggaggaggcagagtggcagacgaggtggttctacccaggcaataacccctacactgggacccccgactggttgtatgcaggggattactttgagcggaatttctccgactgcccagatatctactgagggcctggaggggcctggggcccgggaccggaggctgacgaggctggacttcctcgagtggccactgtgagcctcgtcacagcagaaaccaacttttctaacgactgagttcgcggagatagcatcatccctgatcaaggatgtaattctaattaactgttgattgccaaacatttcactctgctgtgccgtctcttcataaagcttcacttgggatcatcgtcttcattaaggtttcaacagggaaattcttcacggcgcccttttatgtggcagaaatcagctggggcttgtttagcttccagcacactctcagtcatagcatgtgtagctaaaggaagtaatgggaaggggttcatgttctctttataatgcagtggcaaaaggttctgaaagccttttaaactcgaaccagtgggggaaagatggatcttgaagctaatcctgcagagagttttatagaggccagggattgccttctaaattatgataaaacagaagtgaagagtttcagagcatcagattgagtgaaaagttgtcagattctgtattttttaacaatcttcaataatgtaaagattacttttaaaatatttaagttaaaactacttgaatagtattttgctgaagagcaagatatgcattaatcaccggttttatactgtccaaaatgaagcatccccgtgacaaaccagagtgggcagaagcatcgagagcgtgacaggaaatcccaagactgcttccgcctcagaggcgtcccggctgcgattcgctgccctgttgtcagtgaggcctggctgtcaccgcacaccgcgtccgtgtctccagggggttcctttcttctcacacgtcgcgtgtacccatagcactcttgtgtttctgtttttcccagtatgcatgtttaaaatagaagtgacaagaatcacatccggttgtgtcctgtgggagggtcagaggcagaatctacttacagtggtgtaattaaagttatttaaccaaaaataggtatgtgtccatctcagcattcacctttatcaagtgactgatttttttttcttttctttccttttttttttttttttgagacggagtttcactcttgttgcccaggctggagtgcaatggcatgatctcggctcaccgcaacctccgcctcccgggttcaagcgattctcctgcctcagcctcccaagtagctgggattacaggcacgcgccaccacacctggctgattttgtatttttagtagacacgggttttcaccatgttggtcaggctggtctcaaactcccgacctcaagtagtctgcctgcctcaacctcccaaagtgctgggattacaggcgtgagccactgcgcctggccgtgactgattttttttcatgtagaattgtcaacacgagagatcacagtggagcactttgaaagaccgtcggttgtgtgcacgcacgcacacactcatgcacacgctgacacgcggttgcatggagtccaggttactcaggccggcacttctgagtgacaggtgccacctgcgtgtgtcttggcgtccacatcacacctgtgacggaagcacttctggaagtgaacactcgttttgaaagcttgattttgtagctttggaagctggaagcgatggtgtttggtgccgagtcctgtgtcatcctcggggcctatgagctccgtaccagccactcaaaagtgtctgaacagaaccgctccgtgactggtagctgggtctgaggattcaggattgtggcgttattcaaagaggagactttgaaattccccgatggctggaatgtggagcccaggtgcctctggtggagggtcatctgcttttccagactgtggttgtgaaccggctccttctccaagaaaggttgcaagctgagaacatccagaggtgagactcagacacattgaaagtgactgcatttagggaggtttaacgagttcttactgatcattccacttgttactggttaagataatttgcccacgggtttgtttccaagtcctcttctaggaccaggctcctggtatttcaggggctggttggctgcacagacagcccctcttctgctgtccttgaggacagacaccaaaccagaggtggaggaagaacggtaggaaggctgatggcaaaagcggctgtgtgtcgaggttattttaactttttactactttttgttactgtttctgcaaatgctaacacataaaccatgacctaacttttgtcaccttggatatctattgaatgttaaacatctctaataaagatggccaccacttaatgtgtggaaagtgatggccttctcgtgggc

SEQ ID NO: 401 - DNA, 3971 bp, Homo sapiens
agtgggtcgcgggcctacggggcgggggcggggcggcagtgagctcggccggcaaccgagggacccgcgtccagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacaggctttgattctgataactcttctggggaattttcagaggcaaatcagaaagtcacgggaatgattgacttagacaccagcaaaaataataggattgggaaaactggggagaggccctctcaagagaacggaattcagaaacacaggacatcgctgccggctcccatgttcagcagaagcgacttcagcgtgtggaccatcctgaagaagtgtgttggcctggagctgtccaagatcacgatgccaatcgccttcaacgagcctctgagcttcttgcagcggatcacggagtacatggagcacgtgtacctcatccacagggcctcctgccagccccagcccctggagaggatgcagtctgtggctgcttttgctgtttcggctgtggcttcccagtgggagaggaccggcaaaccatttaatccactcttgggagaaacgtatgaattaatcagggaagatttaggattcagatttatatcggaacaggtcagtcaccacccccccatcagtgcgttccactcggaaggtctcaaccatgacttcctgttccatggctccatctaccccaagctcaagttctggggcaaaagcgtggaggcggagccccgaggcaccatcaccctggagctgctcaaacataatgaagcctacacctggaccaaccccacctgctgcgtccacaacgtcatcatcgggaagctgtggatagagcagtatgggacagtggagattttaaaccacagaactggacataagtgtgtgcttcactttaaaccgtgtggattatttggaaaagaacttcacaaggtggaaggacacattcaagacaaaaacaaaaagaagctctttatgatctatggcaaatggacggaatgtttgtggggcatagatcctgtttcgtatgaatccttcaagaagcaggagaggagaggtgaccacctgagaaaggccaagctggatgaagactccgggaaggctgacagcgacgtggctgacgacgtgcctgtggcccaggagaccgtgcaggtcattcctggcagcaagctgctctggaggatcaacacccggccccccaactctgcccagatgtataatttcaccagtttcactgtgagcctcaacgagctggagacaggcatggagaagaccctgccacccacggactgccgcctgcgccctgacatccgcggcatggagaatggcaacatggatctggccagccaggagaaggagcggctggaggagaagcagagagaagcacggagggagcgggccaaggaggaggcagagtggcagacgaggtggttctacccaggcaataacccctacactgggacccccgactggttgtatgcaggggattactttgagcggaatttctccgactgcccagatatctactgagggcctggaggggcctggggcccgggaccggaggctgacgaggctggacttcctcgagtggccactgtgagcctcgtcacagcagaaaccaacttttctaacgactgagttcgcggagatagcatcatccctgatcaaggatgtaattctaattaactgttgattgccaaacatttcactctgctgtgccgtctcttcataaagcttcacttgggatcatcgtcttcattaaggtttcaacagggaaattcttcacggcgcccttttatgtggcagaaatcagctggggcttgtttagcttccagcacactctcagtcatagcatgtgtagctaaaggaagtaatgggaaggggttcatgttctctttataatgcagtggcaaaaggttctgaaagccttttaaactcgaaccagtgggggaaagatggatcttgaagctaatcctgcagagagttttatagaggccagggattgccttctaaattatgataaaacagaagtgaagagtttcagagcatcagattgagtgaaaagttgtcagattctgtattttttaacaatcttcaataatgtaaagattacttttaaaatatttaagttaaaactacttgaatagtattttgctgaagagcaagatatgcattaatcaccggttttatactgtccaaaatgaagcatccccgtgacaaaccagagtgggcagaagcatcgagagcgtgacaggaaatcccaagactgcttccgcctcagaggcgtcccggctgcgattcgctgccctgttgtcagtgaggcctggctgtcaccgcacaccgcgtccgtgtctccagggggttcctttcttctcacacgtcgcgtgtacccatagcactcttgtgtttctgtttttcccagtatgcatgtttaaaatagaagtgacaagaatcacatccggttgtgtcctgtgggagggtcagaggcagaatctacttacagtggtgtaattaaagttatttaaccaaaaataggtatgtgtccatctcagcattcacctttatcaagtgactgatttttttttcttttctttccttttttttttttttttgagacggagtttcactcttgttgcccaggctggagtgcaatggcatgatctcggctcaccgcaacctccgcctcccgggttcaagcgattctcctgcctcagcctcccaagtagctgggattacaggcacgcgccaccacacctggctgattttgtatttttagtagacacgggttttcaccatgttggtcaggctggtctcaaactcccgacctcaagtagtctgcctgcctcaacctcccaaagtgctgggattacaggcgtgagccactgcgcctggccgtgactgattttttttcatgtagaattgtcaacacgagagatcacagtggagcactttgaaagaccgtcggttgtgtgcacgcacgcacacactcatgcacacgctgacacgcggttgcatggagtccaggttactcaggccggcacttctgagtgacaggtgccacctgcgtgtgtcttggcgtccacatcacacctgtgacggaagcacttctggaagtgaacactcgttttgaaagcttgattttgtagctttggaagctggaagcgatggtgtttggtgccgagtcctgtgtcatcctcggggcctatgagctccgtaccagccactcaaaagtgtctgaacagaaccgctccgtgactggtagctgggtctgaggattcaggattgtggcgttattcaaagaggagactttgaaattccccgatggctggaatgtggagcccaggtgcctctggtggagggtcatctgcttttccagactgtggttgtgaaccggctccttctccaagaaaggttgcaagctgagaacatccagaggtgagactcagacacattgaaagtgactgcatttagggaggtttaacgagttcttactgatcattccacttgttactggttaagataatttgcccacgggtttgtttccaagtcctcttctaggaccaggctcctggtatttcaggggctggttggctgcacagacagcccctcttctgctgtccttgaggacagacaccaaaccagaggtggaggaagaacggtaggaaggctgatggcaaaagcggctgtgtgtcgaggttattttaactttttactactttttgttactgtttctgcaaatgctaacacataaaccatgacctaacttttgtcaccttggatatctattgaatgttaaacatctctaataaagatggccaccacttaatgtgtggaaagtgatggccttctcgtgggc

SEQ ID NO: 402 - DNA, 11426 bp, Homo sapiens
agacccgccgggctcccgccgcgcgcgctgtccctggagctcggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccaccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgctggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacatgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgaacaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccaagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggccctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagacgcgcaacactgtgtcccgcgaggagctcatgatggtgctggccagcctggagcagctgcagatccgtgccctcttctcacagatctcctcggctgtcttcctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcgtgagcagcagggacgaccccagcgccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcgatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgacggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgtttttatatttggcccttccacccatttttaattgtgagagatttgtcaccaatcatcactggttcctccttaaaaattaaaaagtaacttctgtgtaa

SEQ ID NO: 403 - DNA, 356 bp, Homo sapiens
ctttctctctcgcgcgcggtgtggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacct

SEQ ID NO: 404 - DNA, 2474 bp, Homo sapiens
cgggccgggggtcgcctcccgcctcccgcctcccgcctcccgccgcccgccgcccgcgtcgccctcgccgccgttgggccgcgccgcgccgccatgtcgggccccggaccgcgggagccgccgccggaggcaggcgcggcaggcggcgaggcggccgtcgagggcgcgggcggcggggacgcggcgctgggcgagccggggctgagcttcacgaccaccgacctgagcctggtggagatgacggaggtggagtacacgcagctgcagcacatcctctgctcgcacatggaggcggcggctgacggcgagctcgagacgcgcctcaactcggcgctgctggcggcggcgggcccgggcgcaggcgcgggcggcttcgcggcgggcggtcaggggggcgcggcgcccgtgtaccccgtgctgtgcccgtccgcgctggcggccgacgcgccctgcctgggccacatcgacttccaggagctgcgcatgatgctgctaagcgaggcgggcgcggcggagaagacgtcgggcggcggggacggagcgagggcccgggccgacggcgccgccaaggagggcgcgggcgcggctgcggctgcggctggacccgacggcgcgcccgaggcccgggccaagccggccgtgcgcgtccgcctggaggaccgcttcaacagcatccccgccgagccgccgcccgcgccgcgcggccccgagccccccgagccgggcggggcgctcaacaatttggtaactctcattcgacatccatctgaactaatgaatgttcctcttcagcaacaaaacaaatgtacagcattagtgaaaaataaaactgcggctacaactactgctttgcaatttacatacccactgtttactacaaatgcttgctctactagtggaaattctaatctttcacagacacagagttctagtaactcatgttctgtacttgaagctgccaagcaccaggatattggattgcctagagcattttctttctgttatcagcaagaaattgaatccactaaacagacgttaggtagtagaaacaaagttttgcctgagcaagtttggattaaagtgggagaagcagcgctatgcaaacaagcactgaagaggaatcggagtagaatgcgtcagttggacacaaatgtagagcgaagagcccttggagagattcagaatgtgggcgaaggtgccaccgccacacaaggcgcttggcagtcctcggagtcctcacaggcaaacctgggggagcaggcccagagtgggccccagggaggaaggtctcaacgtagggagaggcataaccgaatggaaagagatagaaggcgcagaatccgcatttgctgtgatgagttgaatctcttagtgccgttctgcaatgccgagactgacaaggccacaactctgcagtggaccacagcattcctgaaatacatccaggaaagacatggagattctcttaaaaaggaatttgagagcgtattttgcggtaaaactggccgaaggctaaagctgaccagaccggactccttggtgacctgtcctgcacaggggagtttacagagcagcccctcgatggagatcaagtgatcggactgaacaggaatcctcggggggtgaacagccattccttcgtgacctgtgcacgccttctgcaaccctggagctctgctcggctagtctgactcgaaaagggcgtgactcaagctgacgggactccagtagggactttgagagcacattttgtaaaaatatttatctagacgcaaatgcttatccatgaatgtcctcttagaccatttggggatgaagccatcttaataattagtaataattaattagtaataattagtaagcattttctcaatgctctgattccatcatgttttcttaacatgataacttaaaaaattgacatcctttgtactttctttaatcttaaaaagtacacggctttttacttatttaccttttaaatatgcccctttagcaattggaacaagttaaattgttaactaaaaacagtttggaaattttatttcattcgttatatcacacccccttgtcatgactctgagtcacgtgctgctgtattgcaacgtgcaggaccattttaaacctgtgtgctaaaaattttccagatacttgctttaaagctacttttgtccacaaatgaaatactgtcacagtagacgcttaaatgccacgttttcataccaagagtcattcattacttcatgtgtcacaaactgtggtgtttggaattgggtttttcaatgagtggctttacttatcaatcacaacaggtaatagcaatagacgttagtgcaatacaaagtcaccctcaataaatactgttaattggagatgtgagtttgtacacaaaacatcagactagacctttgtatgggagagaatttactgtacattaaattctttattttttgttaaaaaaaaaaaaaaaaaaa

SEQ ID NO: 405 - DNA, 4440 bp, Homo sapiens
ccctcccgctccccgcccccgcccccgcccccgcctccgccgcggcccccacctctgcctccttctactcgggcgccccggcggccgccacctctccccagcccaggagaggctgcggagccgcagccgcccagaccgcgcagcgcgggaggcaggttccgcacgaaataaatcagaatgagttatgcagaaaaacccgatgaaatcacgaaagatgagtggatggaaaagctcaataacttgcatgtccagagagcagacatgaaccgcctcatcatgaactacctggtcacagagggctttaaggaagcagcggagaagtttcgaatggaatctggaatcgaacctagtgtggatctggaaacacttgatgaacgaatcaagatccgggagatgatactgaaaggtcagattcaggaggccatcgccttgatcaacagcctccacccagagctcttggacacaaaccggtatctttacttccatttgcagcaacagcatttgatcgagctgatccgccagcgggagacagaggcggcgctggagtttgcacagactcagctggcggagcagggcgaggagagccgagagtgcctcacagagatggagcgtaccctggcactgctggcctttgacagtcccgaggagtcgcccttcggagacctcctccacaccatgcagaggcagaaggtgtggagtgaagttaaccaagctgtgctagattatgaaaatcgcgagtcaacacccaaactggcaaaattactgaaactactactttgggctcagaacgagctggaccagaagaaagtaaaatatcccaaaatgacagacctcagcaagggtgtgattgaggagcccaagtagcgcctgcgcttgcgtggtggatccaacaccagccctgcgtcgtgggacttgcctcagatcagcctgcgactgcaagattcttactgcagtagagaactctttttctcccttgtacttttttttgacctggcatctttttatagggaaaaatggcctttgtaggcagtggaaaacttgcaaggaaagctgccgtctctttggcagtctgatgcagagcctgcactctggcactcgctgaagaatctggaaggttgcggtttgctcttccagtgttcgggggcctctggctgctgaaggattcggtctaccacggagggctgtgctgttaggctgcatcccactcaaaatacaggaaaagcacgaatcatgattctgctttctgttagcttaggcagacattgggccttcacctacaagtttttccttacccctgtggtttttgtgtttttttttttttctttttccataggaaagaatatataaatttgtaaatcctaattcaaagatggctcatgtgtgagggcattgagtttgatttgttttccctttggtctgggttgtgtggcttttgggggatgcgtgtgagggggctatgtgttttttaattttttaaatatatattttggtgctgtgtgtggtaagagacttgttcctagtggatcaatgaaccatctcttctgggcagttttgttgaaaataaaggtttctctttgatttcaagaatgaccaaaatggcctctaaaagatgttaatcatctcaaatgaccttttgtctttggggcgttcttccccctgtgatagcggcagtggctttttctggtacctgcagctggaaaggccacttggccctgtgctgagtgagcggccttcattagagcgaggcagcccttggccggtggggacgcagagccccagcaggtggtgcacgactgttggcggaaggaacgcgtgttcatcctcagtgatctgccctccagcatctcggcagcatctcatcctccatcgtcagctggctctgccgatgtcctgcttctgttcactcacagaactgtcccctgctccgtggtgggcaggagggaagtggtgcagggctgcgtgcattgcctgcgagtcgggacagttgatgggcacatggccttgtagctctgggcacagatgtgtttggattcattgcagcggaccaccgggcactgttgaccccactgagcagtgctaagtgttggtttagtggatgttcgtggaattgctgacccatccaagggcgtcctttggagccagtggagcctgccggcgcatctgaggggcagaatgctgctagcacttgaatctgggatctcgccttattctcaagtagcaaggcatctcgacaagcatggtctaggtctggtggccagcttgccagtacctgagccggtcgggtcatctgcctctgagggaccgtcctcaccgagctcctgcatcccttgagtgttgatcaggaggcgtccacagcattgttctcgcctctgaatgatgcttctttctgtgttggagcctggcgaagttgtgttttcaagccctctacttctctttccagtgggtaggagcttttggcagtgtttactttacctagatggcttatataatccagtaagagatgcaaagataaaattgctgcggttgttacagaagcatggcggcctccagactgacccattggttgccctttagattttgtaaggatgcggtgctggggaggtggtgcttccctaccccctagaaatgctgccttccaactaccactctcccagatgtgacccttgcgattatttcctctgaggtttgaggatgaagataagttggagggaaagagagtaactaataggggatgaaatatagcagaagctagaagaaagcggtgaggtgagagagatgcatctgcacgttttcttcaacagcaccaggtgattcagcatattcctaattacctttcactattcgtgtatataagatcgtttacttgcataatatatcatcaatttgacatattcttaaaactagagggtgtgagaagcacagcaataggaagtctctccacaaactaggggaacacaaatggggtcattcacgtgcctggactgtcactatgtggctgtcacgtgaagtgctggtgttgatttccatttcagccagtgggtagctgataagccagtgccagcatccagcatgagcagatgtcggggagactgggaagtctccagcgttactgctctccttcccttcatgataagccagtgccagcatccagcgtgagcagacgtcggggagactgggaagtctccgatgttactgcctgccttcctttcgtgtgaggggctgcacttgcttttcttgtgatctgttagtggacgaggtcttccaaggaagtgctttgcacactttctttgctcctttttacagtctttgtctttgcagcaagcaaatgaaattaagccactttgggataatgaacattcagtataattctactttgtctcattttggatctcactgttgtctttataaaaatggcacattttacaaagtagtttattcttattatactttctgctggagagtgccttgaaataaaatgtgagagtattctggtactctgtgttccagatgcatgaaattgggtgaggaataacccctagtctggaatctttgtgaagcatagggttattgcaaggcaaatgggaactaacacatcttgccatttgaatcagggtctccagtttctagaaaaggcagacactggttgggaccaaagtctccatggcacatgactgaagactggtggtcgtgtgtgtgcggagtccacggaagcctcggggaggtggagctgctccttccattccgtcaggacgtgatctgaaaacatgtagagaagatgagttgaggacagcttttctaaggcaatgtgatgtctttgctttcttatttctctttctctgcgttgttagttttgaagagtggaggagctaggggctccagaaagaatcttacacatgtgttgaagacattgatgtcatagggagcggggagctgcattcccttctgggctgttactgctaaatctcagtatgaacagaccaggcggaaagcttggtggccaagcagtctgtgtgcttccccgctgatggagaacgttgcgttgttcacaatagggcctcatgggtgtagccgcatggcagacccatggctggcgcagctgcctgttgccgtctgtcttcagtaactgctgctctgttaactgttctattctgatactacgcgtgttgttttttacaacaggtatgtttttgtttcagaaatatgtattgcttttctcatattttttgcaaattgtattgtcaacatgggtcatttaaagtcctgtatgaaccataacctgctgtggtacctttgtacatgtttgattctgtattctttattccagtgtggcatatgtgcccctctgtatcttttgagaagtgcggaataggttgcttctaccacctgttcttaatgtaacagtaaaagttttcacatttttctcagaaaaaaaaaaaaaaa

SEQ ID NO: 406 - DNA, 3265 bp, Homo sapiens
gcgtgcacgctgacgccgcgcagtctcgtcccctgccgccgccgtcgccgctgctgtcgccgccgccgccgccattggagtcgacgcctcctcagtgcgtccgcgtcccgggctcaccgccgctgccgcctcgccaggggcccgcgcgcccagcagccgccgccgccgcccggccggcgcccggggaattggcggcggggcccggggccgcgcgagctagggtgacaggcccggcctctaggggaggcccgagccggcgggcgccccggccccgcgtctagttgttcatgaagcatgtcggccaccagcgtggacacccagagaacaaaaggacaagataataaagtacaaaatggttcgttacatcagaaggatacagttcatgacaatgactttgagccctaccttactggacagtcaaatcagagtaacagttacccctcaatgagcgacccctacctgtccagctattacccgccgtccattggatttccttactccctcaatgaggctccgtggtctactgcaggggaccctccgattccatacctcaccacctacggacagctcagtaacggagaccatcattttatgcacgatgctgtttttgggcagcctgggggcctggggaacaacatctatcagcacaggttcaattttttccctgaaaaccctgcgttctcagcatgggggacaagtgggtctcaaggtcagcagacccagagctccgcgtatgggagcagctacacctaccccccgagctccctgggtggcacggtggttgatgggcagccaggctttcacagcgacaccctcagcaaggcccccgggatgaacagcctggagcagggcatggttggcctgaagattggggacgtcagctcctccgccgtcaagacggtgggctctgtcgtcagcagcgtggcactgactggtgtcctttctggcaacggtgggacaaatgtgaacatgccagtttcaaagccgacctcgtgggctgccattgccagcaagcctgcaaaaccacagcctaaaatgaaaacaaagagcgggcctgtcatggggggtgggctgccccctccacccataaagcataacatggacattggcacctgggataacaaggggcctgtgccgaaggccccagtcccccagcaggcaccctctccacaggctgccccacagccccagcaggtggctcagcctctcccagcacagcccccagctttggctcaaccgcagtatcagagccctcagcagccaccccagacccgctgggttgccccacgcaacagaaacgcggcgtttgggcagagcggaggggctggcagcgatagcaactctcctggaaacgtccagcctaattctgcccccagcgtcgaatcccaccccgtccttgaaaaactgaaggctgctcacagctacaacccgaaagagtttgagtggaatctgaaaagcgggcgtgtgttcatcatcaagagctactctgaggacgacatccaccgctccattaagtactccatctggtgtagcacagagcacggcaacaagcgcctggacagcgccttccgctgcatgagcagcaaggggcccgtctacctgctcttcagcgtcaatgggagtgggcatttttgtggggtggccgagatgaagtcccccgtggactacggcaccagtgccggggtctggtctcaggacaagtggaaggggaagtttgatgtccagtggatttttgttaaggatgtacccaataaccagctccggcacatcaggctggagaataacgacaacaaaccggtcacaaactcccgggacacccaggaggtgcccttagaaaaagccaagcaagtgctgaaaattatcagttcctacaagcacacaacctccatcttcgacgactttgctcactacgagaagcgccaggaggaggaggaggtggtgcgcaaggaacggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatcaatcagactgatctaatgtgaaatgtaagtatccttaaaaacaaagcatctattttggcagaaattgtgttcttaaattcagtcatttgatattctgtgagacttcatatttctcatccctttattgctttttagcaaacataagaaaccatgagtcattttgtcatttagagtattctgataaaatctcttgaaaatactgaaatcaaaaggttaatgattttttgttcattctgatttgtcattttattatctgttatcggtctaaagtgctaatttacccatttgatttttctgctagacagataacttttaatttttcaaatttggcagacacttttttttttttttgaaaatctttccttccagatctgttgcccactgaacagccacccgtccctcactgtcctggtgtccgattgggctggatggtgttggggcatgatgtgtggaggaactggaaggtgctttaggtctggttcagggtcgggcattctttgttgtttgcacatctttttaaattttacaccttttcttaagaattctaatgccgtcttaagtttttataccaataatgctgagctttaagtgtaggatctggtagtacagacagtgtgatggatgatgctgctggttgtaaatttcatcgtgtgtgtctaattttttttcctgttgaatgggtaaaaacaaaacaaaactttttttagaagatgaatttgctgtcatgttttgtggaatgagggaccgttgagctcactaccacctggagtttgagttgaagcatgaaaatggtgcccatgcctgacgctccagcgcctggatctgcacgtgcccttgtagaggatccttaccgtcctagagagcagacgctttctgaaaactacttgctccaaaagaccctctgagttaacgtttcagctgtatcattagacttgtatttagagcgtgtcacttcctctgaactgttactgcctgaatggagtcctggacgacattgggtttttcctctaggagaatacaagccttaataaacaatactatttagcaaaaaaaaaaaaaaaa

SEQ ID NO: 407 - DNA, 1741 bp, Homo sapiens
agcggagcgcggaggccgctgggacgcggttcagctcattccctgaggccggcccgcgtcccgtcaggcgccgcgcggggttagcgcggggtcagcggaggtcagcgggggtcagcagcagcggctccgagggcgcggcggacgcaggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgagattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtggaggctcctggctgttggacacgg

SEQ ID NO: 408 - DNA, 1997 bp, Homo sapiens
acttccggaagcggcggcgctcgggaggaagtgccgatcggctgctggggcgaaaagggggcgccgggccgctctagccggtgaggccggcgggctctctgtggctgcggctgggaaaccgcgcggaggaggtgcccggccggggaccagccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcaggttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcggacgccgtggactctgcacagtcctctgccctctgtccgtctcttgcagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtca

SEQ ID NO: 409 - DNA, 2832 bp, Homo sapiens
acttccggaagcggcggcgctcgggaggaagtgccgatcggctgctggggcgaaaagggggcgccgggccgctctagccgccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcaggttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagaggtatggcagcagctgcggagcccaggagccaggaaggtggggtcaccctgagaggctcctggccggtgagggcaccaaccatctaaccaaactattggagagtgtgtgactgcggcgagggtgccacctgtgcctgaggaggccgtgtgggtaggggtagatccgtggcggcctttatcttcaaggagtgtgggtgcaacagctacagtctcattgatgggaggccatggtcgtggctgtggccatgggagaggaggggcctggagttgccgaggaagtcacagaaaatgaccaactgatggggcctggagtgcaggaggggcagctcctctgcatggcttctcagacttgggacctgggtgcctgggatcctggcagacagaggttgtgtccagacagccagcatggaagtttcgggaatgggaactggtgggcagtgtccagctctccagaggggtgtgtgtatgcgtgtgcgtgtgtgtgtatatatgtgggaggtcacctgacccaagcatggcgggctgagtccaggaggggtctgcatgttggaggtgtacccagggatcagtgatggtggtttctgaagccccatgtccctggtgaaggaggactgaaccaaggactctgtgagggcaggtgaggcgctcacagcctcgcgaaggtggagaagggcaggggcaggagagggctgcggaggaggggccacggtgcagcaggccgtggggactgccatgcactctgcctggtgtcacatgcccacagcagcctcggtgacgagagcacggagcccaagaggtggggtgtcgtggctctgcccaggatctgagctcattggtcaaagcccgggtcaccatgcacaatcctctggcctggctgggccactgccctctgtccatctcttgcagtggtggggtcggacgccgtggactctgcacagtcctctgccctctgtccgtctcttgcagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtca

SEQ ID NO: 410 - DNA, 1881 bp, Homo sapiens
acttccggaagcggcggcgctcgggaggaagtgccgatcggctgctggggcgaaaagggggcgccgggccgctctagccgccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcaggttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggttctcccatgggcaggtggtctctctggatgagctgcgccccttccaggacccagacctgagctccctgcaggccggctctgcgtgtctggccaagcaccaggatggcctctggcacgcagcacgcatcaccgatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagagtggtggggtcagatgctgtggactctgggacctgcagctctgcctttgctggctgggaggtgcacacgcgaggtataggctccagactcctcaccaagatgggctatgagtttggcaagggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtcaaaaaaaaaaaaaaa

SEQ ID NO: 411 - DNA, 1741 bp, Homo sapiens; identical to SEQ ID NO: 407

SEQ ID NO: 412 - DNA, 1997 bp, Homo sapiens; identical to SEQ ID NO: 408

SEQ ID NO: 413 - DNA, 2832 bp, Homo sapiens; identical to SEQ ID NO: 409

SEQ ID NO: 414 - DNA, 1881 bp, Homo sapiens; identical to SEQ ID NO: 410

SEQ ID NO: 415 - DNA, 2357 bp, Homo sapiens
atcgcggattacgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaaaaaaaaaaaaaaaa

SEQ ID NO: 416 - DNA, 2297 bp, Homo sapiens
atcgcggattacgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctacaagaagactcaggaaactctttcacaggcaggacagaagacttcagctgccctgtccacagtgggctctgccatcagcaggaagcttggagacatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaaaaaaaaaaaaaaaa

SEQ ID NO: 417 - DNA, 2426 bp, Homo sapiens
atcgcggattacgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgagggctcatccattttcacactcctttagcagctactccatccgccactcaataagtatgccagccatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaaaaaaaaaaaaaaaa

SEQ ID NO: 418 - DNA, 2366 bp, Homo sapiens
atcgcggattacgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctacaagaagactcaggaaactctttcacaggcaggacagaagacttcagctgccctgtccacagtgggctctgccatcagcaggaagcttggagacatgagggctcatccattttcacactcctttagcagctactccatccgccactcaataagtatgccagccatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaaaaaaaaaaaaaaaa

SEQ ID NO: 419 - DNA, 4738 bp, Homo sapiens
atcgcggattacgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctatgtgaaaacttctgagaaacttggagagtggaatgagaaagtgacccagtcagacctctacaagaagactcaggaaactctttcacaggcaggacagaagacttcagctgccctgtccacagtgggctctgccatcagcaggaagcttggagacatgagcagctactccatccgccactcaataagtatgccagccatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaaaaaaaaaaaaaaaaatcgcggattacgaaacgccgcggagctgaggcagttccgctggctagtgtgtacgcggcgagcttctcccggcgccgcccgctcggctcccatagcgcccgcgacagcggtccggacgccgcccgaacatggactccgccggccaagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcctacaagaagactcaggaaactctttcacaggcaggacagaagacttcagctgccctgtccacagtgggctctgccatcagcaggaagcttggagacatgagcagctactccatccgccactcaataagtatgccagccatgaggaactctgcgaccttcaagtcgtttgaggaccgagttgggaccataaagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaaaaaaaaaaaaaaaa

SEQ ID NO: 420 - DNA, 1847 bp, Homo sapiens
ttgcgcgccgcccggccaggcccgcaaagaggcctccgagcgccatggctgcgcccccggcccgcgcggacgctgatccttcgcccacgtcgccacctacggcccgagacacaccaggccggcaggctgagaaaagcgagaccgcgtgcgaggaccgcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggcttgggaggcggcagtgcctctgggaagaccactgtggccagaatgatcatcgaggccctggatgtgccctgggtggtcttgctgtccatggactccttctacaaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactggaaaacactgtatggtgcaaacgtcatcatctttgagggcatcatggcctttgctgacaagacactgttggagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagagggagcggcaacacggtggccatcaacctgattgtgcagcacgtgcacagccagctggaggagcgtgaactcagcgtcagggctgcgctggcctcggcacaccagtgccacccgctgccccggacgctgagcgtcctgaagagcacgccgcaggtacggggcatgcacaccatcatcagggacaaggagaccagtcgcgacgagttcatcttctactccaagagactgatgcggctgctcatcgagcacgcgctctccttcctgccctttcaggactgcgtcgtacagaccccgcaggggcaggactatgcgggcaagtgctatgcggggaagcagatcaccggtgtgtccattctgcgcgccggtgaaaccatggagcccgcgctgcgcgctgtgtgcaaagacgtgcgcatcggcaccatcctcatccagaccaaccagcttaccggggagcccgagctccactacctgaggctgcccaaggacatcagcgatgaccacgtgatcctcatggactgcaccgtgtccacgggcgcggcggccatgatggcagtgcgcgtgctcctggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattgggaactttggcgaccgctactttgggacagacgcggtccccgatggcagtgacgaggaggaagtggcctacacgggttagctgcccagtgagccatcccgtccccaccaccctcctcctgcctcctgacccaggactgttgaatacaaagatgttaatttttaaaatgttactagtataatttattctatgcattttataaaataaataaagctttagaaaaaaaaaaaaaaaaaa

SEQ ID NO: 421 - DNA, 3106 bp, Homo sapiens
tctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccggggcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggagcctcttctcaagtggaccctacgagaaagatgatgaggaagcagatgctatctatgcagccctggataaaaggatggatgaaagaagaaaagaaagacgggagcaaagggagaaagaagaaatagagaaatatcgtatggaacgccccaaaatccaacagcagttctcagacctcaagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgtctgactccgtgagtggacagaccgtcgttgaccccaaaggctacctgacggatttaaattccatgatcccgacacacggaggagacatcaatgatatcaagaaggcgcgactgctcctcaagtctgttcgggagacgaaccctcatcacccgccagcctggattgcatcagcccgcctggaagaagtcactgggaagctacaagtagctcggaaccttatcatgaaggggacggagatgtgccccaagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctgattgagcggttgccatggccggtctccgtggggcagggttgggccgcatgtggaagggctctgagctgtgtcctccttcattaaaagtttttatgtctcgtgtcagaaaaaaaaaaaaaaaaaaaaaaaaaaaaaaaaa

SEQ ID NO: 422 - DNA, 666 bp, Homo sapiens
gatcccggtgccagggaccctgcccagttccaggcgtcgcctaacccagaaacgactgggcgccgcgtcctggaaaggccccagcgcacggacatctgaggagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgcggaggacaaccgcagccacagcgcccacttctttgagtttctcaccaaggagctagccctgggccaggaccggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaaaa

SEQ ID NO: 423 - DNA, 1004 bp, Homo sapiens
atgggtctggagctctacctggacctgctgtcccagccctgccgcgctgtttacatctttgccaagaagaacgacattcccttcgagctgcgcatcgtggatctgattaaaggtcagcacttaagcgatgcctttgcccaggtgaaccccctcaagaaggtgccggccttgaaggacggggacttcaccttgacggagagtgtggccatcctgctctacctgacgcgcaaatataaggtccctgactactggtaccctcaggacctgcaggcccgtgcccgtgtggatgagtacctggcatggcagcacacgactctgcggagaagctgcctccgggccttgtggcataaggtgatgttccctgtgttcctgggtgggccagtatctccccagacactggcagccaccctggcagagttggatgtgaccctgcagttgctcgaggacaagttcctccagaacaaggccttccttactggtcctcacatctccttagctgacctcgtagccatcacggagctgatgcatcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcttaagacttgcccaagtcccagagcacctcacctcccgaagccaccatccccaccctgtcttccacagccgcctgaaagccacaatgagaatgatgcacactgaggccttgtgtcctttaatcactgcatttcattttgattttggataataaacctggctcagcctgagcctctgcttct

SEQ ID NO: 424 - DNA, 2368 bp, Homo sapiens
ccacgcgtccgaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatgtcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccgtgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaa

SEQ ID NO: 425 - DNA, 2368 bp, Homo sapiens; identical to SEQ ID NO: 424

SEQ ID NO: 426 - DNA, 2368 bp, Homo sapiens; identical to SEQ ID NO: 424

SEQ ID NO: 427 - DNA, 2580 bp, Homo sapiens
tcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctcctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgctctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaggaaaccaaagtctgccgcccacctcgctcccctctggaatcttccccaagggccaaacccacttctggcctccagcctttgctccctccccgctgccctttggccaccagggtagatttctcttgggcaggcagagagtacagactgcagacattctcaaagcctcttatttttctagcgaacgtatttctccagacccagaggccctgaagcctccgtggaacattgtggatctgaccctcccagtctcatctcctgaccctcccactcccatctccttacctctggaaccccccaggccctacaatgctcatgtccctgtccccaggcgagccctccttcaggggagttgaggtctttctcctcaggacaaggccttgctcactcactcactccaagaccaccagggtcccaggaagccggtgcctgggtggccatcctacccagcgtgcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgagg

SEQ ID NO: 428 - DNA, 2969 bp, Homo sapiens
agggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcgggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcatgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattgaaaaaaaaaaaaaaa

SEQ ID NO: 429 - DNA, 5273 bp, Homo sapiens
aaggactagagagcgagccgcaaggaagtcggtgcagtcgagacccccctccccatcccagcgcatcgcgtctccgccgagcttgagggcacgccggggacccctccccagagccggccggaccccaggtgccgaggccttggggagcgcggggcgtcccgggtcgcggtgccctcgggacgagacagcccctggcagtgccaccaccgcagccgccgggcgatctccaagcggcgatctctaagcgctgctctctgctcggccgcgggccaggaggggagggtccggccttgccccgcaggcgtccattggcggcttcccccggcctccgcgccatgccgcgggccgtgtgaaaggcggcagcaccggaacccgcaggtgtccgcgggcgcgccaagcccttttgggtagggggcgccttactcgctatgctgcaagggccccgggccttggcttcggccgctgggcagaccccgaaggtggtgcccgcgatgagccccacagagctgtggccatccggcctcagcagcccccagctctgcccagctactgctacctactacacaccgctgtacccgcagacggcgcctcccgcagcggcgccaggcacctgcctcgacgccactccccacggacccgagggccaagttgtgcgatgcctgccggcaggccggctgccggccaaaaggaagctggatctggaggggattgggaggcccgtcgtccctgagttcccaacccccaaggggaagtgcatcagagtggatggcctccccagccccaaaacccccaaatcccccggggagaagactcggtatgacacttcgctggggctgctcaccaagaagttcatttacctcctgagcgagtcagaggatggggtcctggacctgaactgggccgctgaggtgctggacgtgcagaagcggcgcatctatgacatcaccaacgtgctggaaggcatccagctcatccgcaagaaggccaagaacaacatccagtgggtaggcaggggaatgtttgaagaccccaccagacctgggaagcagcaacagctggggcaggagctgaaggagctgatgaacacggagcaggccttggaccagctcatccagagctgctctctgagcttcaagcacctgactgaggacaaggccaacaagaggctggcctatgtgacttaccaggatatccgtgctgttggcaactttaaggagcagacagtgattgccgtcaaggcccctccgcagacgagactggaagtgcccgacaggactgaggacaacctgcagatatatctcaagagcacccaagggcccatcgaagtctacctgtgcccagaggaggtgcaggagccggacagtccttccgaggagcctctcccctctacctccaccctctgccccagccctgactctgcccagcccagcagcagcaccgaccctagcatcatggagcccacagcatcctcagtgccagcaccagcgccaaccccccagcaggccccaccgcctccatccctggtccccttggaggctactgacagcctgctggagctgccgcacccactcctgcagcagactgaggaccagttcctgtccccgaccctggcgtgcagctcccctctgatcagcttctccccatccttggaccaggacgactacctgtggggcttggaggcgggtgagggcatcagcgatctcttcgactcctacgaccttggggacctgttgattaattgagtggccctgcctgcccccagcagcctgcccccgactctacctcctcacagacaggctgacagcccctctgcctgcacagggacattggacactaggtgctgccctcagggcatggggtctcctcgcctttcctgccccagccggcagaagctgtgtggggagatatgaatggtacgggtgaggagtggataaggggtggtcctcaccttcctaatggaagctgggcctagggaggcccatccagtcttctgacttctgacctctcacaagaaggctgcaggtgaggtggccaagtccagggaaaggccctgctacctccttttgaggggtaattaggaccctcgacgtaccaagaagcacataatgcctttgtatttatttcaggttgagttgtttgtttgtcctccctgagttttagcagggaggttgttctagtttttagtgagacctctgcagacaggcccatcactgtccatgttccagggcaggtctgggtttccaagggaggggcccaggctacatccttggtttccccactgtggtgggggctgggactctgaggggctgtccagtctgctagaatgctaattgcacttaggcctcatggttctagtaaacggcagctgtgggcccttttgcctcttcccctgttcttggcctcacatctccagctgagctgccggtcttggcttcctggtcgcctctgtcccagagatggtcccagggagccatcctagggcaggtagcactgaggctcctgtggaaacaggagccacctgctcaggagacccctttcctgaggaagtccttacctctccccttgagatgtaaaaatggtccagcagagacaagctcccgtggaaaacagacaggagcatgggggcagctgtcatggctgtggcgggcacttttcctcagagtttctgccttgcgctggtccaggagccattttgcaccaaggacttggtaggcagaggcagccccactgtaaagaagggtcagattaaaacaaaaaactgccaaaagcatcccctctgccccccatgtggcactggcatcattctctgcttccctgggaggaattttttcaccatgttattgaaggggatggttcattaaggactccacccctcagagctcactcagaccccaaggacagaggtgactggggcttggtgacttgttcactccttttttcccaggtatactgaaggggtgacagagagaggtcttcatggcagaccaggccttcacagctaatggggagaggaactcatgttacctctgcaggcctggggtcctgagggggtcttttggcttcagcctgttcccccagaggcttgatcatcccacattgtcccttcagctcagctgctcttctcccccacccaccctgggatgtgggtgctctgggctgaaccaaggctatgacttctggagagaggctcaggggttggtctgagaggcctgccatccacccctcagggagctaggttttctcagaggctcagctggacagcactttttagaaaagtttgtagcattaagctggtttaaaatatgaagttggttttgttggatggctcctgagctgactgactgatgtctgaagtttgagacgagggattatttcagggtggggcccaatgtgatctaatgcccagctggggacaattgtgcctcatcatttgctcaaattcctgggcccccaagttagccccctcccaggagtggtcagcgggtcacagctgcccccactctataagcagggctaattgtgtaccctttgcagaaatgcttttggtctcctacccaaatactcacaagggtcttatcagacgcccgtcttaaagtccagcatgctcagggaccctgtgtaggatctcgtttgtggtgagtgggctgctctgaggtctccactgggctgccatttagccatgtgccatctctgaagtcagaggtgtttgactcccattccttgggctctggagctttccccaagaattacatcagagaaaaggaagaaggggcctgcaggacccattgggaatgagtttaatactgaagtctggaatgtaagctcatgccctagaggcctctccatatggctggtcaggggagctgccttcaggcttgtgccccgtgtgctcagcagctgcctctgtccccctctactgtccctttcacaccttgcctggccaaggggctagacctcccaggctaagcctcagattcagtgcaggacacaagctcatgcccccgtcttgccagtgacacttgaagcctcccgacttccacagagtgcttcaggacacattttgagtggtattttcttttctttttttcttctttttttttttttttgagatggagtctcgctctgttgcccaggctggagtgcagtggcctgatctcggctcactgcaacctctgcctcccaggttcaagcgattcttctgcctcagcctccagagtagctgggactatagacatgcaccaccacgcccggctaattttgtatttttggtcgagacggggttttgccatgttagtcaggctggtcttgaactcctgacctcaagtgatccaccacctcggcctcccaaagtgttgagatgacaggcacgagccaccaggcccagcctgagtggtattttctttagggaccaggtagactttaaaacgagggtaagagaaaagccagtgtctttctgaggtaaataatttctgccaggaaacttcccagccccaccagcagcccccctaaaaaaatcactcgtgtccccagggacttctaaagcttggggctccaggaaatcatccagtagagttggagattcagagatttcttgaagccagggacatgctcctaactcctttcccattaaaggtgttagaatagaccagagggtgtcccttttccacagtaatgggatcggctggtgtgccttcagggaggaagagggaggtggtcaagcttgaaaaactggctttaggatggttctgactttgttctccctccccaagtgttctcaacctccattctgcagtgttcagagttttagggaaagggtttgggtgccccagcatccaggtgttgtgtggcttagcgcatgtgaagtgaaaaccttctggggttgtttggaagcagctttctggttcttgtgattgtatcctgaggtcccagaaccctattctcccacgaggatcctcagtgaccatggtggccacacgcctggccagcctgctggctcctgggtgagctgaagaaccttgcctgtggcacttttcgagggtgagctggaaccgagagaacatggtccccgtgctgggactcatgcgggtcatttcctgccggcctggtttcgcctggtcgtgtctttatgagcaccatgtaagcctccttgtattgagataattgggcattaaacattaaactgcagctctgggaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 430 - DNA, 1648 bp, Homo sapiens
ggaagttccggcgggggcggccgagggggaagagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggcccccccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaaaaaaaaaaaaaaaaaaaaaaaaaa

SEQ ID NO: 431 - DNA, 1471 bp, Homo sapiens
gactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgtagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggaggaactcagggccctggagctgctggggccaagccaagggcctcccctacctcaaaccccagctgggcccgcttagcccaccaggcatgaggccaaggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactgg

SEQ ID NO: 432 - DNA, 1568 bp, Homo sapiens
gaattccggccaagatggcagcaatgaggaaggcgcttccgcggcgactggtgggcttggcgtccctccgggctgtcagcacctcatctatgggcactttaccaaagcgggtgaaaattgtggaagttggtccccgagatggactacaaaatgaaaagaatatcgtatctactccagtgaaaatcaagctgatagacatgctttctgaagcaggactctctgttatagaaaccaccagctttgtgtctcctaagtgggttccccagatgggtgaccacactgaagtcttgaagggcattcagaagtttcctggcatcaactacccagtcctgaccccaaatttgaaaggcttcgaggcagcggttgctgctggagccaaggaagtagtcatctttggagctgcctcagagctcttcaccaagaagaacatcaattgttccatagaggagagttttcagaggtttgacgcaatcctgaaggcagcgcagtcagccaatatttctgtgcgggggtacgtctcctgtgctcttggctgcccttatgaagggaagatctccccagctaaagtagctgaggtcaccaagaagttctactcaatgggctgctacgagatctccctgggggacaccattggtgtgggcaccccagggatcatgaaagacatgctatctgctgtcatgcaggaagtgcctctggctgccctggctgtccactgccatgacacctatggtcaagccctgaccaacaccttgatggccctgcagatgggagtgagtgtcgtggactcttctgtggcaggacttggaggctgtccctacgcacagggggcatcaggaaacttggccacagaagacctggtctacatgctagagggcttgggcattcacacgggtgtgaatctccagaagcttctggaagctggaaactttatctgtcaagccctgaacagaaaaactagctccaaagtggctcaggctacctgtaaactctgagccccttgcccacctgaagccctggggatgatgtggaaataggggcacacacagatgattcatggatggggacatggaaatgagaataggttaaatggtgcaggtacctcatagccagctctacacagaggtctctcctggcagaaagcaggcgaagggcaggaggagctgcttggcagaaggacctcctgcccagacctgaggagtgagaggctttgagggctgaagtctccctttgttacggaccctggcccaggagttgaatgcctgaggacgtgtgggaaccccgttccctacttagcatgatccttgagtctcctctctggatggaatccgcgagctggccacctggccaccctctacacggctccaccctgccatggccgtggggcccttgctctctgacttctcaggacacaggtcatggaggttcttcccaagctggcagaggccatttgtggaaagtggagagctacgtggtggccgtctgccaactccagcatctctggaaaatctccacgctgaatgtgatttttgaaaacagcttatgtaattaaaggttgaatggcacatcat

SEQ ID NO: 433 - DNA, 1648 bp, Homo sapiens; identical to SEQ ID NO: 430

SEQ ID NO: 434 - DNA, 2035 bp, Homo sapiens
gaattccgggctccggggatgaggtcgcggccggcgggtcccgcgctgttgctgctgctgctcttcctcggagcggccgagtcggtgcgtcgggcccagcctccgcgccgctacaccccagactggccgagcctggattctcggccgctgccggcctggttcgacgaagccaagttcggggtgttcatccactggggcgtgttctcggtgcccgcctggggcagcgagtggttctggtggcactggcagggcgaggggcggccgcagtaccagcgcttcatgcgcgacaactacccgcccggcttcagctacgccgacttcggaccgcagttcactgcgcgcttcttccacccggaggagtgggccgacctcttccaggccgcgggcgccaagtatgtagttttgacgacaaagcatcacgaaggcttcacaaactggccgagtcctgtgtcttggaactggaactccaaagacgtggggcctcatcgggatttggttggtgaattgggaacagctctccggaagaggaacatccgctatggactataccactcactcttagagtggttccatccactctatctacttgataagaaaaatggcttcaaaacacagcattttgtcagtgcaaaaacaatgccagagctgtacgaccttgttaacagctataaacctgatctgatctggtctgatggggagtgggaatgtcctgatacttactggaactccacaaattttctttcatggctctacaatgacagccctgtcaaggatgaggtggtagtaaatgaccgatggggtcagaactcttcctgtcaccatggaggatactataactgtgaagataaattcaagccacagagcttgccagatcacaagtgggagatgtgcaccagcattgacaagttttcctggggctatcgtcgtgacatggcattgtctgatgttacagaagaatctgaaatcatttcggaactggttcagacagtaagtttgggaggcaactatcttctgaacattggaccaactaaagatggactgattgttcccatcttccaagaaaggcttcttgctgttgggaaatggctgagcatcaatggggaggctatctatgcctccaaaccatggcgggtgcaatgggaaaagaacacaacatctgtatggtatacctcaaagggatcggctgtttatgccatttttctgcactggccagaaaatggagtcttaaaccttgaatcccccataactacctcaactacaaagataacaatgctgggaattcaaggagatctgaagtggtccacagatccagataaaggtctcttcatctctctaccccagttgccaccctctgctgtccccgcagagtttgcttggactataaagctgacaggagtgaagtaatcatttgagtgcaagaagaaagaggcgctgctcactgttttcctgcttcagtttttctcttatagtaccatcactataatcaacgaacttctcttctccacccagagatggcttttccaacacattttaattaaaggaactgagtacattaccctgatgtctaaatggaccaaagatctgagatccattgtgattatatctgtatcaggtcagcagaagaaggaactgagcagttgaactctgagttcatcaattctaatatttggaaattatctacaatggaatcttccctctgttctctgataacctacttgcttactcaatgcctttaagccaagtcaccctgttgcctatgggaggaggtggaaggatttggcaagctcaaccacatgctatttagttagcatcagttgtcaccaacagtctttctgcaaagggcaggagagctttgggggaaaggaaaaggcttaccaggctgctatggtcaactcttcagaaattttcagagcaatctaaaagcgccaaaattcgctatgtttacagtgatactattaagaaaatgaatgtgattctgctctgtctttttaagtatgatcaaataaaaaatttgtacatcacaatcatttctacc

SEQ ID NO: 435 - DNA, 3990 bp, Homo sapiens
ggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcgtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaatttaaaaaaaaaaaaaaaaaaaaaaaaaaaaaaaaaaaaaaaaaaaaaaaaaggaaaaaaaaaaaaaaaa

SEQ ID NO: 436 - DNA, 4318 bp, Homo sapiens
aagcggctcgggctgcggctggctcagagtgccgcggggggcgtggggcggtgctgaggagctgaagccgtggccagctcgactccggacagtccagcgagcagcacggcgggaaccggcagccggagcagtcccggagcagaagcagcagcagcagcagcagccctcgccgttcgcggagcgcagccgagccggccatggcgttgtcgatgccgctgaatgggctgaaggaggaggacaaagagcccctcatcgagctcttcgtcaaggctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaggtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaggagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagcgttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattctttctggtgattctgaaccttgcctcatagcttaaagtataaaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgacataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttctttgtaattttggctttcacaatttatctttaaatccttgagcaatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattggtacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttcttttatctttggaacatcagcaccagtatattgctggcagctattgtattaaaaaataaagtatattttcactatcaaaaaaaaaaaaaaaaaaaaaaaaaaaa

SEQ ID NO: 437 - DNA, 1431 bp, Homo sapiens
ggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaactgtcggaaaaggtaacagaagatggaactcgaaatcccaatggaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattcttaaaaaaaaaaaaaaaaaa

SEQ ID NO: 438 - DNA, 1542 bp, Homo sapiens
gctctcggccaatgcggagccccgcgcggaggtcacgtgcctctgtttggcgcttttgtgcgcgcccgggtctgttggtgctcagagtgtggtcaggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgtagcaaaaaaaaaaaaaaaaaa

SEQ ID NO: 439 - DNA, 649 bp, Homo sapiens
cgtgtcagtggtggacctgacctgctcctggccccttggctggccgggctgtttctggccatgggtcgctcccgccggacaggcgcgcaccgagcgcactctctagcccggcagatgaaggcgaagcggcggcggccggacttggatgagattcaccgcgagctgcggcctcagggatccgcacgaccccagcccgacccaaacgccgagttcgaccccgacctgccagggggcggtctgcaccgctgtctggcctgcgcgaggtacttcatcgattccaccaacctgaagacccacttccgatccaaagaccacaagaaaaggctgaagcagctgagcgtcgagccctacagtcaggaagaggcggagagggcagcgggtatgggatcctatgtgccccccaggcggctggcagtgcccacggaagtgtccactgaggtccctgagatggatacctctacctgacatggcctgaagatgcagggcagaggaattgcccatggacagtgacgcaaggactaggctgggagggagcgtgccaaccccttttgcctctgggtttggggagcggagggcctcttcttggtgccctgcccccaataaaggaactggacaaagagaaaaaaaaaaaaaaaaaaaaaaaaaaaaa

SEQ ID NO: 440 - DNA, 1198 bp, Homo sapiens
gagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcattgttgtttttgggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggc

SEQ ID NO: 441 - DNA, 3206 bp, Homo sapiens
ctggtgactcgcggcggcggcggcggacggcccagccggagcgcgaggggctcgggggggcgcggcggttcgggtcgcagagccagggaccccaggacccgggaggcggcgcagccggggccgccggaggagcgcgggtgacctggcggcggcgagatgccgctcgcccagctcaaggagccctggccgctcatggagctagtgccgctggacccggagaatggacagacctcaggggaagaagctggacttcagccgtccaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggccgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacagagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccatgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaactgttgagttgaaaaaaaaaaaaaaaaaaaa

SEQ ID NO: 442 - DNA, 2380 bp, Homo sapiens
gtccccgccggggaggtcgggacgggcaggggctgaggaccccgcgccagcttgggagccctggagttctggcgggagggaagctgtcaaatggaagccggtagaaatgagacagacgcccggagaagcggggagccccgcccctccgccatagcagcctcgggcgccgcctcttcctttccagcctcccgccctcgtctgcttccggccctgtggcctggtggggctctgcaggctccctcgggagtggtccttgggccgtggcccctctgggaggcctgagggagctcaatcctggtagcaacacccctgaattcctggtggtgaaaggatgtggccccaggacccatcccggaaggaggtgctgaggtttgcagtcagctgccgtatcctgactctgatgctgcaggccctcttcaatgccatcatcccagatcaccatgcagaagccttctctcctcctcgcctggccccctcaggctttgtggaccaactcgtggaaggtcttctgggcggcctgtctcactgggatgctgaacacttcttgttcattgctgagcatggctacctgtatgagcacaactttgccttctttcctggtttccccttggccctgctggtggggactgaactgttgagacccttacgggggttactgagtctacgcagttgcctgctgatttcggtagcatcactcaatttcttgttcttcatgttggctgcagttgcacttcatgacctgggttgtctggttttgcactgtccccaccagtccttttatgcagctctgcttttctgtctcagccctgccaatgtcttcctggcagctggttactcagaagctttgtttgccctcctgacattcagtgccatggggcagctggagaggggccgagtctggactagtgtactcctctttgcctttgccactggggtacgctccaacgggctggtcagtgttggcttcctcatgcattctcaatgccaaggctttttctcttctctaacgatgctgaatcctctgagacagctctttaagctgatggcctctctgtttctgtcggtgttcacacttggccttccctttgccctctttcagtattatgcctacacccaattctgtctgccaggctcagcccgccccattcctgagcctttggtacagttagctgtagacaagggctaccggattgcagagggaaatgaaccgccttggtgcttctgggatgttccactaatatacagctatatccaggatgtctactggaatgttggctttttgaaatactatgagctcaagcaggtgcccaattttctactggctgcaccagtggctatactggttgcctgggcaacttggacatacgtgaccactcacccttggctctgccttacacttgggctgcaaaggagcaagaacaataagaccctagagaagcccgatcttggattcctcagtcctcaggtgtttgtgtacgtggtccacgctgcagtgctgctgctgtttggaggtctgtgcatgcatgttcaggttctcaccaggtttttgggctcctccactcctattatgtactggtttccagctcacttgcttcaggatcaagagccgctgttgagatccttaaagactgtgccttggaagcctcttgcagaggactccccaccaggacaaaaggtccccagaaatcctatcatgggacttttgtatcactggaaaacctgttctccagtcacacgatacattctaggctacttcctgacttactggctcctgggactactcctacattgcaacttcctgccttggacatgacctggactctccagggacaggttggaagccaacttaacccaggggtctgaaagtaaaaatacacattggaactgcctctgctgccctgggatcattactgtgtccattataatctttctctttctctttgaaagctggtcaggaatgggagaagtgtcagacactagagagccccttctggtcctggctagggcaaattttagacaactattttctctgtaagtgaagattgtcgtattccaagtctaaaatacacctggatctgtctagtcaatcaacatagcagagacagtcttaaacctaccattgacctgtgtgtaaatttaaatgtcaatttattgaagtgtaaatttcatcaaaggcattagctgacaggctggtaacagtccacacaagatggtataggcctgaacagtgtagtggcagtaataaagtgggaccattttttccaaatgcgacattgtttctgatgtttttttttatgatttgtgcatgtatttttatatgaaaaaaacttacaaagatatgcaaattaaacttctttcagttataaaaaaaaaaaaaaaa

SEQ ID NO: 443 - DNA, 2380 bp, Homo sapiens; identical to SEQ ID NO: 442

SEQ ID NO: 444 - DNA, 2123 bp, Homo sapiens
tagctgatcatgtgacaatccaagatggcggtgcccggcgaggcggaggaggaggcgacagtttacctggtagtgagcggtatcccctccgtgttgcgctcggcccatttacggagctattttagccagttccgagaagagcgcggcggtggcttcctctgtttccactaccggcatcggcctgagcgggcccctccgcaggccgctcctaactctgccctaattcctaccgacccagccgctgagggccagcttctctctcagacttcggccaccgatgtccggcctctctccactcgagactctactccaatccagacccgcacctgctgctgcgtcatctcggtaagggggttggctcaagctcagaggcttattcgcatgtactcgggccgccggtggctggattctcacgggacttggctaccgggtcgctgtctcatccgcagacttcggctacctacggaggcatcaggtctgggcccctttcccttcaagacccggaaggaactgcagagttggaaggcagagaatgaagccttcaccctggctgacctgaagcaactgccggagctgaacccaccagtgctgatgcccagagggaatgtggggactcccctgcgggtctttttggagttgatccgggcctgccgcctaccccctcggatcatcacccagctgcagctccagttccccaagacaggttcctcccggcgctacggcaatgtgccttttgagtatgaggactcagagactgtggagcaggaagagcttgtgtgtacagcagagggtgaagaaataccccaaggaacctacctggcagatataccagccagcccctgtggagagcctgaggaagaagtggggaaggaagaggaagaagagtctcactcagatgaggacgatgaccggggtgaggaatgggaacggcatgaagcgctgcatgaggacgtgaccgggcaggagcggaccactgagcagctctttgaggaggagattgagctcaagtgggagaagggtggctctggcctggtgttttatactgatgcccagttctggcaggaggaagaaggagattttgatgaacagacagccgatgactgggatgtggacatgagtgtgtactatgacagagatggtggagacaaggatgcccgagactctgtccaaatgcgtctagaacagagactccgagatggacaggaagatggctctgtgatcgaacgccaggtgggcacctttgagcgccacaccaagggcattgggcggaaggtgatggagcggcagggctgggctgagggccagggcctgggctgcaggtgctcaggggtgcctgaggccctggatagtgatggccaacaccccagatgcaagcgtggattggggtaccatggagagaagctacagccatttgggcaactgaagaggccccgtagaaatggcttggggctcatctccaccatctatgatgagcctctaccccaagaccagacggagtcactgctccgccgccagccacccaccagcatgaagtttcggacagacatggcctttgtgaggggttccagttgtgcttcagacagcccctcattgcctgactgaccgggttgggggcttcctttcatagctacatgatgaaaaccctctgccctggcctcatctaccactgaagcagaaaggagtctgggagcagcagtcttcgtggctggttcagggtgttttgttccgagcctgcctgcctgccggttctatacctcaggggcatttttacaaaaagccccctcccgtcccctccccttggatattaggggtaacgaccgcttgtctttggtctctaaccctaatctctgggcttgccctttgcctcctgcagaactttgaaaagctgggttgagtgaggctatcagcacagccttccttggggactctgaaggtgtccccacgaaggccagaaagggggaaagggacctgggcgaggagaggatttgtggtgcttggaagagccggccttgggtgggccctccaccgcctctaccctcactgggtgggactgccagcggagagtccgcgggaggtggcttgggtgtgcgacgtcacggaagaataaagacgtttactactgg

SEQ ID NO: 445 - DNA, 1397 bp, Homo sapiens
cggctccgctgcggaaggcggacgactagagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggcgtgcaggagcttgtgaacaccttcttcagcttccttcgacgcaaaacagactttttcattggaggagaagaagggatggcagagaagcttatcacacagactttcagccaccacaatcagctggcacagaagacccggcgggagaagagagcccggcaggaggccgagcggcgggagaaggcggagcgggcggccagactggccaaggaagccaagtcagagacctcagggccccagatcaaggagctaactgatgaagaggcagagaggctgcagctagagattgaccagaaaaaggatgcagagaatcatgaggcccagctcaagaacggcagccttgactccccagggaagcaggatactgaggaagatgaggaggaagatgagaaggacaaaggaaaactgaagcccaacctaggcaacggggcagacctgcccaattaccgctggacccagaccctgtcggagctggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgaccctgagatcaacaccaagaagattaaccctgagaattccaagctgtcagacctggacagtgagactcgcagcatggtggaaaagatgatgtatgaccagcgacagaagtccatggggctgccaacttcagacgaacagaagaaacaggagattctgaagaagttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctccccagttggcctactgttacacattaaaacgatttgcccagctaaaaaaaaaaaaaaaaaaaaaaaaaaaaaaaaaaaaaaaaaaaaaaaaaaaaaaaaaaaaaaaaaaaaaa

SEQ ID NO: 446 - DNA, 1802 bp, Homo sapiens
ccaccccggtgcgcgggtatggcggccagcctgtggatgggcgacctggaaccctacatggatgagaacttcatctccagagcctttgccaccatgggggagaccgtaatgagcgtcaaaattatccgaaaccgcctcactgggatcccagctggctactgctttgtagaatttgcagatttggccacagctgagaagtgtttgcataaaattaatgggaaaccccttccaggagccacacctgcgaaacgttttaaactgaactatgccacttacgggaaacaaccagataacagccctgagtattccctctttgtgggggacctgaccccggacgtggatgatggcatgctgtatgaattcttcgtcaaagtctacccctcctgtcggggaggcaaggtggttttggaccagacaggcgtgtctaagggttatggttttgtgaaattcacagatgaactggaacagaagcgagccctgacggagtgccagggagcagtgggactggggtctaagcctgtgcggctgagcgtggcaatccctaaagcgagccgtgtaaagccagtggaatatagtcagatgtacagttatagctacaaccagtattatcagcagtaccagaactactatgctcagtggggctatgaccagaacacaggcagctacagctacagttacccccagtatggctatacccagagcaccatgcagacatatgaagaagttggagatgatgcattggaagaccccatgccacagctggatgtgactgaggccaacaaggagttcatggaacagagtgaggagctgtatgacgctctgatggactgtcactggcagcccctggacacagtgtcttcagagatccctgccatgatgtagccaggccaaaggacaagccaggttgcatgatgtgagggagatgagagactcctttttaaaaattgtgaaacctttttggaaatatgatttgtaagattttaataatgactgtttttggagatcatgaatgtttctacaacactgctgcattcatttgaccatttgagtttgaagaccaagggaacaacttttaaacaaggttcaaattggtttccttcacaggaatcctttgtccaggtagttatccacataggacagtttgggattatccaaaactgggatgagcagcttgggataattcacacactaaagcctgagttcaaggtttctcagttgacaggtaggtatgtaaatcagggttctctggagtatttgtaggacctgccatatttgagtcctaacttggtgcaagtctggcagctaggtagaaaaggcactctagcaggtgtggtaggagcacgccccagaaggtagaatgtggtggggtgtgatggaacaggccagttggcctaagaattagtacttgctctaataatgggtttcatctattttcatgagttgcagcatctgcatatacaaggcctggatcactttaggatcaatattttgacacgggagaaggcagctcagaaaggattaaggaagatagctcaaagccaaagcagaccctccgtgtgaactttatactgctcacttccgtgtttcccaagtaaatggggaaactgtccaaccttgtcatgtgttgggacttactgcttgaggcaaagcattcatcctacatcataaaaaatctccaaagatctctttaagggctgggcatggtggctcactttgggagatggattgcttgagctcgggaagagaccagttcggtctctacaaaaaaatacaaacacaaatataaaaaaaaaaaaaaaaaa

SEQ ID NO: 447 - DNA, 1113 bp, Homo sapiens
ccgcgcagtcggaccggctgctgagacgaacgcttcactggggcagtctctgcatatcatggggagatagacgctgctgcctttaattggccttggtcctcacagctccaaaaagaaacaggatctcgataagctctatgagctgaagtccaaagctcggcagattatgaaccagtttggcccctcagccctaatcaacctctccaatttctcatccataaaaccggaaccagccagcacccctccacaaggctccatggccaatagtactgcagtggtaaagataccaggcactcctggggcaggaggtcgtcttagccctgaaaacaatcaggtattgaccaagaagaaattacaggacttagtaagagaagtggatcctaatgagcagttggatgaagatgtggaggagatgctgctgcagattgctgatgattttatcgagagtgtggtgacagcagcctgtcagcttgcgcggcatcgcaagtctagcaccctggaggtgaaagatgtccagctgcatttagagcgccagtggaacatgtggatcccaggatttggttctgaagaaatccgaccctacaaaaaagcttgcaccacagaagctcacaaacagagaatggcattgatccggaaaacaaccaagaaataacacacggaaaggtcagggaatggacagcaatgtatttggagatacttgagctgagaactcagccatctcatccttggatttttttttttaatgctttacagagaagcatatattttttattaacagtgcagcaatatctataatgactgagaggatctgccaaaagaataaagcctcctaccccaacttccggtcccttttccctgccatctcaaagaggagcaatgtatcttccagagaagattttatttgtggtttattatataagtgactgaatatgggacaaagcattatggtctttttgggtaagacagtattagcaggatttgtaaagggttttgtttccttctcccttcccccttttccctgtactttgtaatgtcagtgtttatatgaatatgactttcatttcatttgcttttccagaataaagaagttattaataaaaaaaaaaaaaaaaa

SEQ ID NO: 448 - DNA, 1960 bp, Homo sapiens
aagcccggcctggcggcggcggtggcggtagctgccgtggcggcctctgcgcatgctccgtcgcctgcccgccctggccgctcgccgcccgcccgcccgacggagacgcagtcccagctatctgacttcatgtgaaagatggctaatgcagaagtgagtgtcccagtgggggatgtggttgtggtacctactgaaggaaatgaaggggagaatcctgaagacactaaaacccaagtgattttgcagttacagcctgtgcaacaaggtttgtttatcgatggacacttttacaacaggatttatgaagctgggtcggagaacaacacggcagttgtagcagtagaaactcacacgatacacaaaattgaagaagggattgatacaggcactatagaagcaaatgaggatatggaaattgcttaccccataacttgtggggagagcaaagccatcctcctctggaagaagtttgtatgtccaggaataaacgtgaagtgtgtcaagttcaatgatcagttgatcagccccaagcactttgttcatctggctggcaagtccactctgaaggactggaagagagctattcgtctgggtgggatcatgctcaggaaaatgatggactccggacagattgatttttaccaacatgacaaagtttgctccaatacctgcagaagcaccaaatttgatcttctgatcagcagtgcaagagctccagtgccaggacagcagacaagtgtggtgcagacacccacttcggctgatggtagcatcacgcagattgccatctcagaagagagcatggaagaggcagggctggaatggaactcagctctcaccgctgctgtcaccatggccacggaggagggtgtaaagaaagactcagaggaaatttcagaggacactttgatgttctggaaaggaatagctgatgtagggctgatggaagaggttgtctgcaatatacagaaggaaatagaggagctactcaggggagttcagcagcggctcatccaggctcccttccaagtcacagatgctgctgttctcaacaatgtagcacacacatttggcctaatggacacagtcaagaaggttttagacaacagaaggaaccaagtagagcagggagaagaacagtttctctatactctgacagacttggaacgccagttggaggagcagaagaagcaaggccaggatcacaggctgaaatctcagacagttcaaaatgtggtactgatgcctgtgagcactcctaagcctccaaaaaggccccggctccagcggccagcctccaccactgtcttgagcccttctcctcctgtccagcagcctcagttcacagtcatctcacccatcaccatcaccccagtgggtcagtcattttccatgggcaatattccagtggccaccctcagccagggctccagtcctgtgactgtccacacactgccttctggccctcagctcttccgctatgccacagtggtctcctctgccaagagcagctcaccagacacagtgaccatccacccttcatctagcttggcgctgctgagctctactgccatgcaggatgggagtacactgggcaacatgaccaccatggttagccctgtggaattggtggccatggagtccggcctaacctcggcaattcaggctgttgaaagcacctcagaggatgggcagaccatcattgagattgatccagccccggacccagaagctgaagatactgagggcaaagcagtcatcttggagacagagctgaggactgaggagaaagttgtggctgagatggaagaacaccagcatcaagttcacaatgtggagattgtggtcttagaggattaactggggatctcagggccaggagttatgttttgatttggaattttaattatttgtttatttttatcattgtcccactcatttccacataggaccctttttt

SEQ ID NO: 449 - DNA, 1944 bp, Homo sapiens
aagcccggcctggcggcggcggtggcggtagctgccgtggcggcctctgcgcatgctccgtcgcctgcccgccctggccgctcgccgcccgcccgcccgacggagacgtcccagctatctgacttcatgtgaaagatggctaatgcagaagtgagtgtcccagtgggggatgtggttgtggtacctactgaaggaaatgaaggggagaatcctgaagacactaaaacccaagtgattttgcagttacagcctgtgcaacaagggatttatgaagctgggtcggagaacaacacggcagttgtagcagtagaaactcacacgatacacaaaattgaagaagggattgatacaggcactatagaagcaaatgaggatatggaaattgcttaccccataacttgtggggagagcaaagccatcctcctctggaagaagtttgtatgtccaggaataaacgtgaagtgtgtcaagttcaatgatcagttgatcagccccaagcactttgttcatctggctggcaagtccactctgaaggactggaagagagctattcgtctgggtgggatcatgctcaggaaaatgatggactccggacagattgatttttaccaacatgacaaagtttgctccaatacctgcagaagcaccaaatttgatcttctgatcagcagtgcaagagctccagtgccaggacagcagacaagtgtggtgcagacacccacttcggctgatggtagcatcacgcagattgccatctcagaagagagcatggaagaggcagggctggaatggaactcagctctcaccgctgctgtcaccatggccacggaggagggtgtaaagaaagactcagaggaaatttcagaggacactttgatgttctggaaaggaatagctgatgtagggctgatggaagaggttgtctgcaatatacagaaggaaatagaggagctactcaggggagttcagcagcggctcatccaggctcccttccaagtcacagatgctgctgttctcaacaatgtagcacacacatttggcctaatggacacagtcaagaaggttttagacaacagaaggaaccaagtagagcagggagaagaacagtttctctatactctgacagacttggaacgccagttggaggagcagaagaagcaaggccaggatcacaggctgaaatctcagacagttcaaaatgtggtactgatgcctgtgagcactcctaagcctccaaaaaggccccggctccagcggccagcctccaccactgtcttgagcccttctcctcctgtccagcagcctcagttcacagtcatctcacccatcaccatcaccccagtgggtcagtcattttccatgggcaatattccagtggccaccctcagccagggctccagtcctgtgactgtccacacactgccttctggccctcagctcttccgctatgccacagtggtctcctctgccaagagcagctcaccagacacagtgaccatccacccttcatctagcttggcgctgctgagctctactgccatgcaggatgggagtacactgggcaacatgaccaccatggttagccctgtggaattggtggccatggagtccggcctaacctcggcaattcaggctgttgaaagcacctcagaggatgggcagaccatcattgagattgatccagccccggacccagaagctgaagatactgagggcaaagcagtcatcttggagacagagctgaggactgaggagaaagttgtggctgagatggaagaacaccagcatcaagttcacaatgtggagattgtggtcttagaggattaactggggatctcagggccaggagttatgttttgatttggaattttaattatttgtttatttttatcattgtcccactcatttccacataggacccttttttaaaaaaaaaaaaaaaaa

SEQ ID NO: 450 - DNA, 2730 bp, Homo sapiens
gccgcgcgctgtgtctccgctgcgtccgccgaggcccccgagtgtcagggacaaaagcctccgcctgctcccgcagccggggctcatctgccgccgccgccgcgctgaggagagttcgccgccgtcgccgcccgtgaggatctgagagccatgtcggccagcagcctcttggagcagagaccaaaaggtcaaggaaacaaagtacaaaatggatctgtacatcaaaaggatggattaaacgatgatgattttgaaccttacttgagtccacaggcaaggcccaataatgcatatactgccatgtcagattcctacttacccagttactacagtccctccattggcttctcctattctttgggtgaagctgcttggtctacggggggtgacacagccatgccctacttaacttcttatggacagctgagcaacggagagccccacttcctaccagatgcaatgtttgggcaaccaggagccctaggtagcactccatttcttggtcagcatggttttaatttctttcccagtgggattgacttctcagcatggggaaataacagttctcagggacagtctactcagagctctggatatagtagcaattatgcttatgcacctagctccttaggtggagccatgattgatggacagtcagcttttgccaatgagaccctcaataaggctcctggcatgaatactatagaccaagggatggcagcactgaagttgggtagcacagaagttgcaagcaatgttccaaaagttgtaggttctgctgttggtagcgggtccattactagtaacatcgtggcttccaatagtttgcctccagccaccattgctcctccaaaaccagcatcttgggctgatattgctagcaagcctgcaaaacagcaacctaaactgaagaccaagaatggcattgcagggtcaagtcttccgccacccccgataaagcataacatggatattggaacttgggataacaagggtcccgttgcaaaagccccctcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaaagaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaagacataggacttaactggaaaatgaaaagaaaagaaaaagaaaaaactaaacaaaaaatccctctaggtagtttaggtgaaaaatgtcccttttattttggctttggttgtgatttcagagcataatgctatgttttttgtctttttactatgtttttcggatttttaagtccgtaagtgcatacagttttctctaatttttaaaccctttcctcctcccatttggacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatcaaaaaaaaaaaaaaaaaaa

SEQ ID NO: 451 - DNA, 2158 bp, Homo sapiens
ccgttgccgccgccgccgctgccgccgtgctctcgctttgcccgccgccgcctaaggggggctggggccggggccagccatcactgccgttgccgggatgccgcgggtgtacatcggccgcctgagctaccaggcccgggagcgcgatgtggagcgcttctttaagggctacgggaagatcctggaggtggatctgaagaacggatatggttttgtggagtttgatgatctgcgtgatgcagatgatgctgtttatgaactgaatggcaaagacctttgtggtgagcgagtaattgttgagcatgcccgcggcccacggcgagatggcagttacggttctggacgcagtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtctcgctctcgaagcagacattcccgtaagagcagaagccgaagtggcagcagcaaaagcagtcattctaagagtagatctcggtccaggtcgggctcccgctcccggagcaagagccggagccggagccagagtcggagccggagcaagaaagagaaaagcaggagccccagcaaggaaaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagggggcagcaggagccggagcaggagccgcagcaagagcaaggacaagaggaagggcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaaaaaaaaaaaaaaa

SEQ ID NO: 452 - DNA, 1352 bp, Homo sapiens
caggctctgtgttggttggagcgagcatgtgggtctgcagtaccctgtggcgggtgcgaaccccgcccggcagtggcgggggcctgctcccagcttctggctgtcacggacctgccgcctcctcctactccgcatccgccgagcctgcccgggtccgcggcgttgtctatgggcaccacggggatccagccaaggtcgtcgaactcaagaacctggagctagctgctgtgagaggatcagatgtccgtgtgaagatgctggcggcccctatcaatccatctgacataaatatgatccaaggaaactacggactccttcctgaactgcctgctgttggagggaacgaaggtgttgcacaggtggtagcggtgggcagcaatgtgaccgggctgaagccaggagactgggtgattccagcaaatgctggtttaggaacctggcggaccgaggctgtgttcagcgaggaagcactgatccaagttccgagtgacatccctcttcagagcgctgccaccctgggtgtcaatccctgcacagcctacaggatgttgatggacttcgagcaactgcagccaggggattctgtcatccagaatgcatccaacagcggagtggggcaagcggtcatccagatcgccgcagccctgggcctaagaaccatcaatgtggtccgagacagacctgatatccagaagctgagtgacagactgaagagtctgggggctgagcatgtcatcacagaagaggagctaagaaggcccgaaatgaaaaacttctttaaggacatgccccagccacggcttgctctcaactgtgttggtgggaaaagctccacagagctgctgcgccagttagcgcgtggaggaaccatggtaacctatggggggatggccaagcagcccgtcgtagcctctgtgagcctgctcatttttaaggatctcaaacttcgaggcttttggttgtcccagtggaagaaggatcacagtccagaccagttcaaggagctgatcctcacactgtgcgatctcatccgccgaggccagctcacagcccctgcctgctcccaggtcccgctgcaggactaccagtctgccttggaagcctccatgaagcccttcatatcttcaaagcagattctcaccatgtgatcatcccaaaagagctggagtgacatgggaggggaggcggatctgaggggctgggtgcaggcccctcagttggggctcccaccttccccagactactgttctcctcactgcctcttcctattaggaggatggtgaagccagccacggttttccccagggccagccttaaggtatctaataaagtctgaactctcccttccaaaa

SEQ ID NO: 453 - DNA, 2493 bp, Homo sapiens
tgggctaccagtgggctcccatcctagccaacttcctgcacatcatggcagtcatcctgggcatctttggcaccgtgcagtaccgctcccggtacctcatcctgtatgcagcctggctggtgctctgggttggctggaatgcatttatcatctgcttctacttggaggttggacagctgtcccaggaccgggacttcatcatgaccttcaacacatccctgcaccgctcctggtggatggagaatgggccaggctgcctggtgacacctgttctgaactcccgcctggctctggaggaccaccatgtcatctctgtcactggctgcctgcttgactacccctacattgaagccctcagcagcgccctgcagatcttcctggcactgttcggcttcgtgttcgcctgctacgtgagcaaagtgttcctggaggaggaggacagctttgacttcatcggcggctttgactcctacggataccaggcgccccagaagacgtcgcatttacagctgcagcctctgtacacgtcggggtagcctctgccccgcgcccaccccggcgcctcgccctgggctgaccgcagctgccgcgagctcgggccaaggcgcaggcgtgtccccctggtggcccgcgctctcactgcagcctgtgcccaaccccgcgtctgcatctggagatgcggacttggacgtggacttggacttggacttggatttgagcttggctcttcgcagcccggacttcggaggagtggggcggggcgggggaggggcaccacgggttttttgttttttgtttgtttgtttttaatctcagccttggcgtgagctggggccttcctctcttctccagcctctccctttcactcttcgcccagcatcctgcccccctgtccaaaaacagcaggacatcaggcccatcccatcccaccacactcactcaccagctctggggaaagctactgtgaactaggagcaggattcctgggttctaatcgcaggtccatcactgactgtgacgtctagcaaagcccttgccctctctgagcctcggtttccgcacctcaagtaattaatcccttagcaaatggactcttttagacttctcatttaactcaattccctgagctagactgggattaaaattctcattttgcagtacattaaaactgatgcccagagatgtgatttgcttgaggccacacagctagatttttggtggaagtgggccttgaacacagtgtactttctgcagtttctgactgtaaaacccagtgtctgctctctgagttccatttccaagcccccctccatcttggacctatgtggtctccaccatattcacacaccaccaccaccacttgccaatgcctctcttaaagcaatatacccattcgttctcttattgggaactggatggatgaagccccaaattcagccccacccacagagaagccttcctacactcagcctctgtccacccttggcaaatctttcaagctctctcctccaggaaagtggggccccaactcagtcactccacccccttccaggtccctgaggctggttctactgtatccccatcacctccacaactccactcacccctgacggctccatccacctcaccagttggaaggcttgtggtttcagagaggagcaatgctggtcagcgctgcccagactccagtgtttacagatcaccagcatttacaaccaatccaatggccagaagcctcctctaacaagcccagaaggagttctgaaggggcagatgggggtgtgagtagtcggggagtcgggattgccagcaccctcacccttccttgggggcaagtagaggtgagaacactttccccacctccctccacagacactcctgaggacgctgcatcccacgcactgcctggtgcgtccatagagagaggatcaggtctcagcatttcatctgtgaaagaggcatggccctgggttagaaaggagggcaggagacatggaggaactggggggcacccagatggtgcagatggtttgcacacctgagcctgtctgtggtgaccattccgctcctctcccactaccctccaatctatcattccctactctctaaggccaaaatatcctgagcaaggctggcaaccccaccccaccatcccaaatgcaagcagccaggcccaggagttcctctggcccccacaggcatggagctcccagctggtgggtacagcttgagaggggggcagctccctcaggctaagctactgcccttcactgggccagccctgcctccagccctcacctctctcaccccaactctcccccaagcccctttctactcaacgggtgtagccactggtgctttgaagccttttgtttttataagatggtttttgcaaggggaccaggttctcttttcactgggaccttgcaaggaggggagtgctctcctggtttctgtgcaggcgggttgattaaagatggtgttttcttctct

SEQ ID NO: 454 - DNA, 5295 bp, Homo sapiens
cggggctgcgggcccggcggccgggctggctgggccgcgcttgggttcccgcgccggctcccgcacccgcaatggggaactcacaccacaagaggaaggcccccagcggtccccgggtccgcagcttctggcggttcgggcggtcggcgaagcggccggcaggctctgccaaggctgagaatgacaaacatctaagtgtagggcctggccaggggccagggtctgcagtggatgagcaccaggacaacgtcttctttcccagtgggcgacccccccacctggaagagctgcacactcaggcccaggaggggctccgctccctacaacaccaagagaaacagaaactgaacaagggtggctgggaccatggagacacccagagtatccagtcctcccggacggggccggatgaagacaacatctccttctgcagtcagaccacatcctacgtggctgagagctccacagcagaggacgcgctctccatccgctcggagatgatccagcgcaaaggctccaccttccgaccccatgactcatttcccaaatctggaaagtcagggcggcgtcggcgggagcggcggagcactgtgctgggactcccgcagcatgtgcagaaggagcttggcctgaggaatgagcgtgaggcaccaggcacgccccgggctcctggtgcacgggatgccgtacgcatccccacagtggacggccgcccccgaggcacctcagggatgggggcccgggtgtccctgcaggcgctggaggcggaggcggaggctggcgctgagacagaggccatgctgcagcgccacattgaccgtgtctaccgggatgacacctttgttggccggtccacgggtacccgggccccaccattgacccggcccatgtccctagcagtgcctggattgacaggaggggcagggcctgcagagcccctgagcccggccatgtccatctccccccaggccacctacctgtcgaagttgattccacatgctgtgctgccgcctacagtggacgtggtggccctaggccgctgcagcctgcgcacactaagccgctgcagcctgcactcggccagcccagcctcagtccgctcgctggggcgcttctcctccgtctccagcccacagccccgcagccgccacccatcctcctccagtgacacctggagccactctcaatcctccgacaccattgtgtctgacggttccaccctctcctctaagggtggctctgagggccagccggagagctctacggctagcaatagcgtggtaccccctccccagggaggcagtgggaggggctctcccagtgggggcagcactgctgaggcctcagacacactcagcattcggagcagtgggcagttgtctggccggagtgtgtccctgcgtaagctgaagcggcctccaccccctccccgccggacccactccctccatcagcggggcttagcagtgcctgatgggccattagggttgccccctaagcctgagcgtaagcagcagccccagctgcctcggccacccaccactggtggctcagaaggggcgggggcagcaccctgtccacccaacccagccaacagctgggtacctggcttgtctccgggtggttcccggcgccccccacggtccccagaacggacactttcgccctccagtggatactcgagccaaagtggtactcccaccctccctcccaagggcctggcaggtccccctgcttccccaggcaaggcccagccccctaaaccagagcgtgtcacgtctcttcgctcccctggggcctccgtctcctcttccctcacgtctttatgttcctcctcctctgacccagccccctcagaccgctctgggccacagatattgacccccctgggtgacaggtttgtcatacctcctcaccccaaggtgcctgcccccttctccccacctccctccaagcccaggagccctaacccagctgcccctgctctagccgcccctgctgtggttcctgggcctgtttctaccactgacgccagtcctcagtcccctcccactccccagacaaccttgactccactgcaggagtctcctgtcatctccaaagaccagtcacccccaccttccccacccccatcttatcatccacccccaccacccactaagaagccagaggtggttgtggaggcaccatctgcctcagagactgctgaggagcccctccaagatcccaactggccccctcccccaccccctgcccctgaggagcaggacctgtccatggctgacttccccccaccagaggaggcttttttctctgtggccagccctgagcctgcaggcccttcaggctccccagagcttgtcagctccccggctgcttcgtcctcctcagctactgctttgcagattcagcccccgggtagcccagaccctcctccagctccgccagccccagctcctgctagttccgccccagggcatgtggccaagctccctcagaaggaaccggtgggctgtagcaagggtggtgggcctcccagggaggacgtaggtgcgcccctggtcacgccctcgctcctgcagatggtgcggctgcgctccgtgggtgctccaggaggggctcccaccccagcactggggccatcggccccccagaaaccactgcgaagggccctgtcagggcgggccagcccagtgcctgccccctcctcagggctccatgctgcggtccgactcaaggcctgcagcctggccgccagtgaaggcctctcaagtgctcagcccaacggaccgcctgaggcagagccacggcctccccagtcccctgcctcaacggccagtttcatcttctccaagggctctaggaagctgcagctggagcggcccgtgtcccctgagacccaggctgacctccagcggaatctggtggcagaactccggagcatctcagagcagcggccaccccaggccccaaagaagtcacctaaggctcccccacctgtggcccgcaagccgtctgtgggagtccccccacccgcctcccccagttaccctcgagctgagccccttactgctcctcccaccaatgggctccctcacacccaggacaggactaagagggagctggcggagaatggaggtgtcctgcagctggtgggcccagaggagaagatgggcctcccgggctcagactcacagaaagagctggcctgaccaccaggcacctcactggcactgctgacccatcccagaaacacaatctcagggacccgagcagctccaaggacgagaggatacagcagacacaacctaatagagagggcgcctgcagccttaacctccacggccttcgatacttatgcaagcctggtgttgctcctgtcctcagagtcatcctgcgctcatgccttttcccgaatgggttcacctctggcagttgccgcttcagtcttggccttagcctcatcttgaagtgggtagctggcgggagagggtggctgcgccccctgctggccctgaggctgcagagttgggagcaggacacctcacctgagtttcattttttttcatgtccaaaccatgcacatactatagtccagaatcaaagcacttttgaaaagtggctgcatggccatcctccagggcccaggaagttgcattccaagggcctgtttacatggcagcagaatccatccccggcagtcagcccatagcttgggaccagtctgtgccctcctgcccagtccagtttactcctcttggttcctgaaggtggccaagtcattgtgttcccacaggcttctctaggctgggggcaggtgtggggctgtggaattccaaagcacaaaaggtgcagaggggattggccttcctgtgcctcaactcaccaaccaccctcctgccttccagttctgccaggtgctccatgctggggacaagtaggagactgccagggcccaaagaaatgggtgagcagtagagtcatctcggggcacttggcagtgtcaagcacctgccccttgcctccttgaccacactggggtgggtgggcccccagcacttcagaggcaggagcctttgggctgagcaagcactgaggaggtggatggaagggagcatctggagggggggagcttccttgagcagtgggcccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctgccccccagggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttg

SEQ ID NO: 455 - DNA, 1988 bp, Homo sapiens
catgctgcgccgctacctagcctcggaccccgactgccgctggtgcccggccccggactgcggttatgctgttattgcctatggctgtgccagctgcccgaagctaacttgtgagagggaaggttgccagactgagttctgctaccactgcaagcagatatggcatccaaatcagacatgcgatatggcccgtcaacagagggcccagactttacgagttcggaccaaacacacttcaggtctcagttatgggcaagaatctggaccagcagatgacgtcaagccatgcccacgatgcagtgcatacattatcaagatgaatgatggaagctgtaatcacatgacctgtgcagtgtgtggctgtgaattctgttggctttgtatgaaagagatctcagacttgcattacctcagcccctctggctgtacattctggggcaagaagccatggagccgtaagaagaaaattctttggcagctgggcacgttgattggtgctccagtggggatttctctcattgctggcattgccattcctgccatggtcattggcattcctgtttatgttggaaggaagattcacagcaggtatgagggaaggaaaacctccaaacacaagaggaatttggctatcactggaggagtgactttgtcggtcattgcatccccagttattgctgcagttagtgttggtattggtgtccccattatgctggcatatgtttatggggttgtgcccatttctctttgtcgtggaggcggctgtggagttagcacagccaacggaaaaggagtgaaaattgaatttgatgaagatgatggtccaatcacagtggcagatgcctggagagccctcaagaatcccagcattggggaaagcagcattgaaggcctgactagtgtattgagcactagtggaagccctacagatggacttagtgttatgcaaggtccttacagcgaaacggccagctttgcagccctctcagggggcacgctgagtggcggcattctctccagtggcaagggaaaatatagcaggttagaagttcaagccgatgtccaaaaggaaattttccccaaagacacagccagtcttggtgcaattagtgacaacgcaagcactcgtgctatggccggttccataatcagttcctacaacccacaggacagagaatgcaacaatatggaaatccaagtggacattgaagccaaaccaagccactatcagctggtgagtggaagcagcacggaggactcgctccatgttcatgctcagatggcagagaatgaagaagaaggtagtggtggcggaggcagtgaagaggatcccccctgcagacaccaaagctgtgaacagaaagactgcctggccagcaaaccttgggacatcagcctggcccagcctgaaagcatccgcagtgacctagagagttctgatgcacagtcagacgatgtgccagacatcacctcagatgagtgtggctccccccgctcccatactgcagcctgcccctcgacccccagagcccaaggtgcaccgagcccaagtgcccatatgaacctctctgccctagccgagggacaaactgtcttgaagccagaaggtggagaagccagagtatgaagtggaatgaatgctcctgttctgagaagcacacttgtaactgcatcttttggaattttttttttttttttttccaaggggtagagatttatgtattttatttcacagattctctggtcacaggtttttgcccagggaaattctgagaaattcacaatttcttaccagataaaacatgaaaagtttgccgttagttcccctcccctcccctccctctttttagttttaatttattggttaaactgatggcagcaatccatgaggtgtgtcaaagagtgtacatatgtatgtgtgtatattgaatgctaaacatattactgaaagacacattttaataaagatttctgtcataattcaactt

SEQ ID NO: 456 - DNA, 2597 bp, Homo sapiens
cattgtctccgcggcggctgcagccctcgagcgcccgccgcgcgcgcgcgcgcaaccccggccgccgcccgcgctcccgccccggcctcgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccagggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccaaagggctgagcctcctggcctgcctgcccgcccaccctgggagtcccagtggtgaggctcagagaactgctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctgaaaaaaaaaaaaaaa

SEQ ID NO: 457 - DNA, 3885 bp, Homo sapiens
catctgcctgcccttctgccatccgagcgccctgactgcgccacactgcaggccatggagaatgagctgccagtcccacatacatctagcagtgcctgtgccaccagcagtaccagcggggccagtagcagcagtggctgcaacaacagcagcagtggtggaagtggccgccccaccgggccccagatttctgtgtacagtggtattccagaccggcagaccgtgcaggtgatccagcaggccctgcacagacagcccagcacggccgctcagtacctgcagcagatgtacgccgcccagcagcagcacctcatgctgcagaccgcggcgctccagcagcagcacctcagcagcgcccagctccagagcctggcagccgtacagcaggcaagcctggtatccaatagacaaggaagcacttcaggcagcaatgtgtctgcgcaggccccggcccagtcatcttcgatcaacctggcagcctccccagcagcagcccagctcctcaaccgggcccagagtgtgaactctgcagcagcctcaggcatcgctcagcaggctgtgctcttgggcaacacgtcttccccagccctgactgcaagccaagcacagatgtatctgagggcacagatgctcatcttcacgcccacggccaccgtcgctactgtgcagcctgagctcggcactggctcccccgcccggccccccacccccgcccaggtacagaacttgaccctccgaacacagcagacaccagcggcagcagcctcgggccccacccccactcagcctgtcctgcccagcttggccctgaaacccacgccgggcggtagccagcctctgcctaccccagcacagagcagaaatactgctcaggcttcccctgcaggtgccaagcctggcatagctgacagtgtgatggagccacacaagaaaggagatggcaacagcagtgtgccagggagcatggaaggccgggctgggctcagccggacggttcctgctgtggctgcccaccccctcattgcaccagcctatgctcagctgcagccacaccagctcctcccacagccatcctcaaagcacctgcagccccaatttgtgatccagcagcagccacagccacaacagcagcagccgccgccccagcagtcacggcctgtgctccaagctgagccccacccccagctcgcctcagtctctccaagcgtggccctccagcccagctcagaggcccatgccatgccactaggcccggttacacccgccctgccactccagtgtcccactgccaacctgcacaagcctggcggcagtcagcagtgtcaccctcccacacctgatactgggcctcagaatggacatcccgagggcgtgccccacacccctcaacgcaggttccagcacacttcagctgtcatcttacaactgcagcctgcttcaccaccccagcagtgtgtccctgatgactggaaagaagtggcaccaggggagaaaagtgtgcctgagacgcggtctggcccatcaccacatcagcaggctattgtcactgccatgcctggtggcctgcctgtacccacgagccctaacatccagccgtccccagctcacgagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccagggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccaaagggctgagcctcctggcctgcctgcccgcccaccctgggagtcccagtggtgaggctcagagaactgctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctgaaaaaaaaaaaaaaa

SEQ ID NO: 458 - DNA, 1812 bp, Homo sapiens
gcggaggggcgggccctggccgggtggtcccgggcggatcccgggaaggcggaaggcttcggcagagctgcgccgccgaggctgagcggtcccttctcgctgcggccgcccaggtgcccgcgcccgtggcgctatggaggcggcgctgctggggctgtgtaactggagcacgctgggcgtgtgcgccgcgctgaagctgccgcagatctccgctgtgctagcggcgcgcagcgcgcggggcctcagccttccgagtttacttctggagctggcaggattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaacaagaataatcacaaccttaatgaccaccaatgattttacaattcttctacgttttgtgatcatgctggctttaaatatatgggtaacagtgacagtacttcgctaccggaagaccgctataaaggctgaatgatggatacattattccttcacacagtggattttgagtaactgaaccaaaggaaaaagaagctctttgctaaattaaggtcttttataaatttagtaaatcagtttataatctttaaagccaaaggtttttttagacttgaaagaaagagccacttaaattcttgtttaaaaataccaatttgcctcctccttcctcacttcgttaggttatggtagtgctcagacatctgcagtgttgaggccagtcactgttggaagtcatccaagaagcccattttgaggccattttgagccttactcttaagttctctatgaagaactacattgatttgttggctttcagaatcttttaggaaataaatcctctccaggacaaaaatgaacatgaatggagtggcattttgttccaagtcagaggtgggcacctataataaatgactagggttcactttctgggactgatgtttaattgtaacacagatacaacagggtggccttgttgtgtataatacggtattatacctgcatgtgctctagcaaggataccaaggcaagcatacatgtagctggcttgagtttgtaccaaaacagtccttcaactttgcactgtgccttaagtaattactaacaaaaggtactaggattagctgcaatctctactttcgatgaggaaatcccagtaagctttctgattcaagtacaatgctgccattttttaaagggccacaactatagaattaccactgttggaatttggtacaaaatatgttttgtctattgaaaacatacacggtaaatggtgttgttaggtaggttctgtccagttcttagggacttttttcacattatagcatttttaccctaaacatgatgttgagattattatatactgtattttcttctaaattaaccctaatgtttaaaaactcactttccccctttaattgaaggcattgttttgttagatgcagtaatgatgtttaccagagattattgtttcctatgcaaaataaattttcatattttgaattctgctgagtcttaaaaaaaaaaaaaaaaaaaaaaaaaaaa

SEQ ID NO: 459 - DNA, 3254 bp, Homo sapiens
ggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaattattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgagggccgcgcattgaagacggcaacctcattggctgaggggctctcgcttgtggtgtctcccgacagcatccacagtgtggctccggagaatgaaggaaggctggtgcacatcattggcgccttacggacatccaagcttttgtctgatccaaactatggggtccatcttccggctgtgaaactgcggaggcacgtggagatgtaccaatgggtagaaactgaggagtccagggagtacaccgaggatgggcaggtgaagaaggagacgaggtattcctacaacactgaatggaggtcagaaatcatcaacagcaaaaacttcgaccgagagattggccacaaaaaccccagtgccatggcagtggagtcattcatggcaacagccccctttgtccaaattggcaggtttttcctctcgtcaggcctcatcgacaaagtcgacaacttcaagtccctgagcctatccaagctggaggaccctcatgtggacatcattcgccgtggagactttttctaccacagcgaaaatcccaagtatccagaggtgggagacttgcgtgtctccttttcctatgctggactgagcggcgatgaccctgacctgggcccagctcacgtggtcactgtgattgcccggcagcggggtgaccagctagtcccattctccaccaagtctggggataccttactgctcctgcaccacggggacttctcagcagaggaggtgtttcatagagaactaaggagcaactccatgaagacctggggcctgcgggcagctggctggatggccatgttcatgggcctcaaccttatgacacggatcctctacaccttggtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgcgtgagccctaggatccaggtcctctctcacctctgacccagctccatgccagagcaggagccccggtcaattttggactctgcactccctctcctcttcaggggccagacttggcagcatgtgcaccaggttggtgttcaccagctcatgtcttccccacatctcttcttgccagtaagcagctttggtgggcagcagcagctcatgaatggcaagctgacagcttctcctgctgtttccttcctctcttggactgagtgggtacggccagccactcagcccattggcagctgacaacgcagacacgctctacggaggcctgctgataaagggctcagccttgccgtgtgctgcttctcatcactgcacacaagtgccatgctttgccaccaccaccaagcacatctgtgatcctgaagggcggccgttagtcattactgctgagtcctgggtcaccagcagacacactgggcatggacccctcaaagcaggcacacccaaaacacaagtctgtggctagaacctgatgtggtgtttaaaagagaagaaacactgaagatgtcctgaggagaaaagctggacatatactgggcttcacacttatcttatggcttggcagaatctttgtagtgtgtgggatctctgaaggccctatttaagtttttcttcgttactttgctgcttcatgtgtactttcctaccccaagaggaagttttctgaaataagatttaaaaacaaaacaaaaaaaacacttaatatttcagactgttacaggaaacaccctttagtctgtcagttgaattcagagcactgaaaggtgttaaattggggtatgtggtttgattgataaaaagttacctctcagtattttgtgtcactgagaagctttacaatggatgcttttgaaacaagtatcagcaaaaggatttgttttcactctgggaggagagggtggagaaagcacttgctttcatcctctggcatcggaaactcccctatgcacttgaagatggtttaaaagattaaagaaacgattaagagaaaaggttggaagctttatactaaatgggctccttcatggtgacgccccgtcaaccacaatcaagaactgaggcctgaggctggttgtacaatgcccacgcctgcctggctgctttcacctgggagtgctttcgatgtgggcacctgggcttcctagggctgcttctgagtggttctttcacgtgttgtgtccatagctttagtcttcctaaataagatccacccacacctaagtcacagaatttctaagttccccaactactctcacacccttttaaagataaagtatgttgtaaccaggatgtcttaaatgattctttgtgtaccttttctgtcatattcagaaaccgttttgtgcctgctgggagtaattcctttagcaattaagtatttggtagctgaataaggggtcagaacttctgaaaccagagatctgtaatcatctctattggcctggggtgcctgtgctataaatgagtttcttcacatgaaaaacacagccagcccaagatgacttatctgggtttaggattcaatagtattcactaactgcttattacatgagcaatttcatcaaatctccaaactcttaaaggatgctttcggaaaacacgctgtatacctagatgatgactaaatgcaaaatccttgggctttggtttttttctagtaaggattttaaataactgccgacttcaaaagtgttcttaaaacgaaagataatgttaagaaaaatttgaaagctttggaaaaccaaatttgtaatatcattgtattttttattaaaagttttgtaataaatttctaaattataaaaaaaaaaaaaaaaaa

SEQ ID NO: 460 - DNA, 3658 bp, Homo sapiens
gcccagacaagcaacatggctcggaaacgcgcggccggcggggagccgcggggacgcgaactgcgcagccagaaatccaaggccaagagcaaggcccggcgtgaggaggaggaggaggatgcctttgaagatgagaaacccccaaagaagagccttctctccaaagtttcacaaggaaagaggaaaagaggctgcagtcatcctgggggttcagcagatggtccagcaaaaaagaaagtggccaaggtgactgttaaatctgaaaacctcaaggttataaaggatgaagccctcagcgatggggatgacctcagggactttccaagtgacctcaagaaggcacaccatctgaagagaggggctaccatgaatgaagacagcaatgaagaagaggaagaaagtgaaaatgattgggaagaggttgaagaacttagtgagcctgtgctgggtgacgtgagagaaagtacagccttctctcgatctcttctgcctgtgaagccagtggagatagagattgaaacgccagagcaggcgaagacaagagaaagaagtgaaaagataaaactggagtttgagacatatcttcggagggcgatgaaacgtttcaataaaggggtccatgaggacacacacaaggttcaccttctctgcctgctagcaaatggcttctatcgaaataacatctgcagccagccagatctgcatgctattggcctgtccatcatcccagcccgctttaccagagtgctgcctcgagatgtggacacctactacctctcaaacctggtgaagtggttcattggaacatttacagttaatgcagaactttcagccagtgaacaagataacctgcagactacattggaaaggagatttgctatttactctgctcgagatgatgaggaattggtccatatattcttactgattctccgggctctgcagctcttgacccggctggtattgtctctacagccaattcctctgaagtcagcaacagcaaagggaaagaaaccttccaaggaaagattgactgcggatccaggaggctcctcagaaacttccagccaagttctagaaaaccacaccaaaccaaagaccagcaaaggaaccaaacaagaggaaacctttgctaagggcacctgcaggccaagtgccaaagggaagaggaacaagggaggcagaaagaaacggagcaagccctcctccagcgaggaagatgagggcccaggagacaagcaggagaaggcaacccagcgacgtccgcatggccgggagcggcgggtggcctccagggtgtcttataaagaggagagtgggagtgatgaggctggcagcggctctgattttgagctctccagtggagaagcctctgatccctctgatgaggattccgaacctggccctccaaagcagaggaaagcccccgctcctcagaggacaaaggctgggtccaagagtgcctccaggacccatcgtgggagccatcgtaaggacccaagcttgccagcggcatcctcaagctcttcaagcagtaaaagaggcaagaaaatgtgcagcgatggtgagaaggcagaaaaaagaagcatagctggtatagaccagtggctagaggtgttctgtgagcaggaggaaaagtgggtatgtgtagactgtgtgcacggtgtggtgggccagcctctgacctgttacaagtacgccaccaagcccatgacctatgtggtgggcattgacagtgacggctgggtccgagatgtcacacagaggtacgacccagtctggatgacagtgacccgcaagtgccgggttgatgctgagtggtgggccgagaccttgagaccataccagagcccatttatggacagggagaagaaagaagacttggagtttcaggcaaaacacatggaccagcctttgcccactgccattggcttatataagaaccaccctctgtatgccctgaagcggcatctcctgaaatatgaggccatctatcccgagacagctgccatccttgggtattgtcgtggagaagcggtctactccagggattgtgtgcacactctgcattccagagacacgtggctgaagaaagcaagagtggtgaggcttggagaagtaccctacaagatggtgaaaggcttttctaaccgtgctcggaaagcccgacttgctgagccccagctgcgggaagaaaatgacctgggcctgtttggctactggcagacagaggagtatcagcccccagtggccgtggacgggaaggtgccccggaacgagtttgggaatgtgtacctcttcctgcccagcatgatgcctattggctgtgtccagctgaacctgcccaatctacaccgcgtggcccgcaagctggacatcgactgtgtccaggccatcactggctttgatttccatggcggctactcccatcccgtgactgatggatacatcgtctgcgaggaattcaaagacgtgctcctgactgcctgggaaaatgagcaggcagtcattgaaaggaaggagaaggagaaaaaggagaagcgggctctagggaactggaagttgctggccaaaggtctgctcatcagggagaggctgaagcgtcgctacgggcccaagagtgaggcagcagctccccacacagatgcaggaggtggactctcttctgatgaagaggaggggaccagctctcaagcagaagcggccaggatactggctgcctcctggcctcaaaaccgagaagatgaagaaaagcagaagctgaagggtgggcccaagaagaccaaaagggaaaagaaagcagcagcttcccacctgttcccatttgagaagctgtgagctgagcgcccactagaggggcacccaccagttgctgctgccccactacaggccccacacctgccctgggcatgcccagcccctggtggtgggggcttctctgctgagaaggcaaactgaggcagcatgcacggaggcggggtcaggggagacgaggccaagctgaggaggtgctgcaggtcccgtctggctccagcccttgtcagattcacccagggtgaagccttcaaagctttttgctaccaaagcccactcaccctttgagctacagaacactttgctaggagatactcttctgcctcctagacctgttctttccatctttagaaacatcagtttttgtatggaagccaccgggagatttctggatggtggtgcatccgtgaatgcgctgatcgtttcttccagttagagtcttcatctgtccgacaagttcactcgcctcggttgcggacctaggaccatttctctgcaggccacttaccttcccctgagtcaggcttactaatgctgccctcactgcctctttgcagtaggggagagagcagagaagtacaggtcatctgctgggatctagttttccaagtaacattttgtggtgacagaagcctaaaaaaagctaaaatcaggaaagaaaaggaaaaatacgaattgaaaattaaggaaatgttagtaaaatagatcagtgttaaactagattgtattcattactagataaaatgtataaagctctctgtactaaggagaaatgacttttataacattttgagaaaataataaagcatttatctaaaaaaaaaaaaaaaaaaaaaaaaaaaaa

SEQ ID NO: 461 - DNA, 579 bp, Homo sapiens
acgaggggaaagggcgcagggtttgaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttctcaagctctccaataaatatgaccaccaaaaaaaaaaaaaaaaaaaaa

SEQ ID NO: 462 - DNA, 2044 bp, Homo sapiens
cctggagttacaatggcggcgcccatgctgcgctggggctgccgtggaagacgttgggctttcgcccgggttgacggtggttcttgccaccgaagaggggctccgactgggtccacatccaaccagattaggggagagagctcagtggctcagcagcccctccacacggcccagaagacgaggaaaggtgaacacaaatgggctgctgtggtaggtttggaaattcatgcccagatttcctccaactctaaactcttctctggatctcaagttcgcttttcagcacctccaaattctttggtttctttttttgatgcatctctacctggaactttgccggttctcaacaggaggtgtgtagaagcggcggtgatgacaggcctggctctgaactgccacataaacaagaagtccttgtttgacaggaagcactacttctatgcagacctccctgcaggctaccaaattacccagcagaggctcccaattgctgtgaatgggagcttgatatatggcgtctgtgcagggaagaagcagagtcaggtgatccccaagacggtgaggatcaagcagatccagttggagcaagacagtggcaaaagcctccacgacaacctgaggtctcagacgctcattgatttgaacagggcaggagtgggccttctggaggtggtcctggagcccgacatgtcctgtggagaagaggcggcaacagctgtcagggagctgcagctgatccttcaagccctggggaccagccaggcgaacatggcagagggccagttgagagtggatgccaatatatccgtgcatcaccctggggagcctttgggcgttcgaacggaagtgaagaatctcaacagcatcaggttcctggccaaagccatagactatgaaattcagaggcaaatcaatgaacttgagaatggaggtgaaattctgaacgaaacacgctcatttcatcacaagctggggtgcaccatgtcaatgagagacaaagaaggaaaacaggactacaggttcatgccagaacccaacctgcctcccctggtgctctacgacgccacatctctgcccgcaggtgcagacccacagcaagtgatcaatattgaccagattcgggagacactcccggagctccccagtgtgacccgagagaagcttgtccaacagtatgggatgctgctggaacacagcttcactttgctgaacgaagtcggcctactggagttcttccaaaatgtgataaaagaaactagggcagagccaaaaaaggtgactagttgggtcctcaacacttttctgggctatttaaagcaacagaacctcgctgtcagtgagagtcctgtcacaccctctgcactcgctgagcttcttgacctgctggacagcagaacaatttcttcatcagcagctaaacaggtgtttgaggaactgtggaagagggaaggcaagactccagggcagattgtttcagaaaagcagcttgaactgatgcaggaccagggggcactggagcagctctgccactctgtgatggaggcccatcctcaagtggtaatggatgtgaagaacagaaaccccagagctataaataaactgattgggttggtccggaaagcgactcaaagccgagcagatccagtcatgataaaggagatcctggagaagaagctgtcattgtgagatgtttgggatccccttgcccaagggacaacaacaaacagtgcagcctgactgggaacaggatcctgtgaaagctgatgcccatgtgccctgagagctgcctctcaatccctgtcccaagccacagctatggcgttaatgtcaccagtgttctcaccctctaggccctgtgcctggaggtgcctccacagccgaccagcagccaccccgcctgcttcatccacatcaggagggtccggtgaggctgcagcagtggttaaggagtaacaccttcttgtattaaggaattttaaactaaataaaatgtatgttggagatactgttaaaaaaaaaaaaaaaaaaaaaaaaaaaaaaaaaa

SEQ ID NO: 463 - DNA, 2518 bp, Homo sapiens
agtcaaggctttgacagggcatagtctcctccaataatcttctccgttctctctcattattccctcgagttcttctcagtcaagctgcatgtatgtatgtgtgtcccgagaagcggtttgatactgagctgcatttgcctttactgtggagttttgttgccggttctgctccctaatcttccttttctgacgtgcctgagcatgtccacattagaatctgtgacatacctacctgaaaaaggtttatattgtcagagactgccaagcagccggacacacgggggcacagaatcactgaaggggaaaaatacagaaaatatgggtttctacggcacattaaaaatgattttttacaaaatgaaaagaaagttggaccatggttctgaggtccgctctttttctttgggaaagaaaccatgcaaagtctcagaatatacaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaagaaaagaaaaagaaaaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagc

SEQ ID NO: 464 - DNA, 2737 bp, Homo sapiens
ctgcagaatgtgaaaacctttgcatcttctgatagtctagccaaggtccaagaagtagcaagctggcttttggaaatgaatcaggaactgctctctgtgggcagcaaaagacgacgaactggaggctctctgagaggtaacccttcctcaagccaggtagatgaagaacagatgaatcgtgtggtagaggaggaacagcaacagcaactcagacaacaagaggaggagcacactgcaaggaatggtgaagttgttggagtagaacctagacctggaggccaaaatgattcccagcaaggacagttggaagaaaacaataatagatttatttcggtagatgaggactcctcaggaaaccaagaagaacaagaggaagatgaagaacatgctggtgaacaagatgaggaggatgaggaggaggaggagatggaccaggagagtgacgattttgatcagtctgatgatagtagcagagaagatgaacatacacatactaacagtgtcacgaactccagtagtattgtggacctgcccgttcaccaactctcctccccattctatacaaaaacaacaaaaatgaaaagaaagttggaccatggttctgaggtccgctctttttctttgggaaagaaaccatgcaaagtctcagaatatacaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaagaaaagaaaaagaaaaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagc

SEQ ID NO: 465 - DNA, 4266 bp, Homo sapiens
ccgggctgtgagtctctcgccgccggaggaagatgaggctgaagattgggttcatcttacgcagtttgctggtggtgggaagcttcctggggctagtggtcctctggtcttccctgaccccgcggccggacgacccaagcccgctgagcaggatgagggaagacagagatgtcaatgaccccatgcccaaccgaggcggcaatggactagctcctggggaggacagattcaaacctgtggtaccatggcctcatgttgaaggagtagaagtggacttagagtctattagaagaataaacaaggccaaaaatgaacaagagcaccatgctggaggagattcccagaaagatatcatgcagaggcagtatctcacatttaagcctcagacattcacctaccatgatcctgtgcttcgcccagggatcctcggtaactttgaacccaaagaacctgagcctcctggagtggttggtggccctggagagaaagccaagccattggttttgggaccagaattcaaacaagcaattcaagccagcattaaagagtttggatttaacatggtggcaagtgacatgatctcactggaccgcaacgtcaatgacttacgccaagaagaatgcaagtattggcattatgatgaaaacttgctcacttcgagcgttgtcattgtcttccataatgaaggatggtcaaccctcatgagaacagtccacagtgtaattaaaaggactccaaggaaatatttagcagaaattgtgttaattgacgatttcagtaataaagaacacttaaaagaaaaactggatgaatatattaagctgtggaatggcctagtgaaggtatttcgaaatgaaagaagggaaggtttaattcaagcacgaagtattggtgctcagaaggctaaacttggacaggttttgatataccttgatgcccactgtgaagtggcagttaactggtatgcaccacttgtagctcccatatctaaggacagaaccatttgcactgtgccgcttatagatgtcataaatggcaacacatatgaaattataccccaagggggtggtgatgaagatgggtatgcccgaggagcatgggattggagtatgctctggaaacgggtgcctctgacccctcaagagaagagactgagaaaaacaaaaactgaaccgtatcggtccccagccatggctgggggattatgtgccattgaacgagagttcttctttgaattgggtctctatgatccaagtctccagatttggggtggtgaaaactttgagatctcatacaagatatggcagtgtggtggcaaattattatttgttccttgttctcgtgttggacatatctaccgtcttgagggctggcaaggaaatcctccgcccatttatgttgggtcttctccaactctgaagaattatgttagagttgtggaggtttggtgggatgaatataaagactacttctatgctagtcgtcctgaatcgcaggcattaccatatggggatatatcggagctgaaaaaatttcgagaagatcacaactgccaaagttttaagtggttcatggaagaaatagcttatgatatcacctcacactaccctttgccacccaaaaatgttgactggggagaaatcagaggcttcgaaactgcttactgcattgatagcatgggaaaaacaaatggaggctttgttgaactaggaccctgccacaggatgggagggaatcagcttttcagaatcaatgaagcaaatcaactcatgcagtatgaccagtgtttgacaaagggagctgatggatcaaaagttatgattacacactgtaatctaaatgaatttaaggaatggcagtacttcaagaacctgcacagatttactcatattccttcaggaaagtgtttagatcgctcagaggtcctgcatcaagtattcatctccaattgtgactccagtaaaacgactcaaaaatgggaaatgaataacatccatagtgtttagagagaaaaaaataaaccaataacctacctactgacaagtaaatttatacaggactgaaaaccgcctggaaacctgctgcaactattgttattaactctgtatagctccaaacctggaacctcctgatcagtttgaaggacattgataaactgtgattttacaataacattatcatctgcagttactgtttacaagactgctttttaccttaaactttgtagatgtttacatcttttttgttgtgttttaaagatgatgttggtaatttgtgccttttagctctgttttattaaacagagttaaagcatgttgtcttctttgggattacactcaggggttctgaaaggcagtttgatttttatttttaacacacttgaaaaaaggttggagtaaccagactttcatatataacttggtgattatcaacctgttgtgtctttatttaattttacatctttttgaagcactgccacaggttattagccaaggtggccttccttcacagtcatgctgcttttttgaaaggtgaatttcaacacatttagtgcctctttcatttctcagtatatatttcaagagcttgtgatgaaatctataggatggtaatgatggacttgtcacctgtatggggaatacttttactactcagaaatgaatttatgtgctgccatttgctataaagttgaactttgtatggcttgaaaaagaaatgaccatatggaacatcccaaggctgtcccataagggttggaagttgtgtagcattcactcccttacctactggcattcccagtgccctctgtccatacctacttctaggattgcaaagggagtcttccaactagaagaaaaattgtccactgacatttgggatttacttttctccaatacctgccaatacagaaaactattatcagttgttattgttatcccttgaaaagcgagggtgacaaaaacaacaaaacaccgttataaacacatcaaaggttcattctgactgaggtaagactttccaagcccttgttagattaggccttataaaacttgtgtgcattataacctaagctgtgcaacctggtgaagccaagagtgaactgatgtttcatttatattttcatccaaatgacattatctgcacgtttttaaaatttaaaaacaaaggactatttaaaaatacagtttattaacaaacgtgaaactactttctgttacattaggtgttccctagtgtttcttaatttctttttagaaagtgtatttttattagtatttttccggtgaacagaagatttgtttggatttaaacatttactaagacagtacctattaggaaaaccaaatattgcaaatggtcaattcgattttaatttctcaaaagatactctgttatccagaagattaaaatgcctacattgagtgcttaaaaaaaaaaacaactgtgatgatgtgagcagaatggcaagtaagttaagcatttttgatcctgtaatcatggtatcattacaatgaaaggaattcacaaactactgccagaggaagtttgttttttaatttaagagggaaatataacctataaatttgtttcttccaagcttagctcttaaatttgggagactcaaagttaaacatcctcaacagagttttatttataattttgaattgtcaatttgtattttgctactgatctgtgatcaaccattttaactttcatctctagggatgtttaacatttataattgcaaaataaaccaactataaaaaaagaaactaagagagaattggtactttaattacttgtgtgtttgcaaataggctccattttccatgttgagtagattataaccttattaactaggcataggcctaagaaaggtggcaatgaactgtgcatgtaaattttaaatgggtactttgtgcaattcgttaaaagaagatactctatgaatatgattctatatattgaaatcagaaaacctaccaaacaaaaacatcagaagctgctgccataatgactattttctactgtaggctgctttggaaataattcccatatccttgctttgtaagttggtaatatcactatgcatttctacacattttataaatttgatttatgcagattttgatacactgtatgtttctgtagaaattgtataaatattcaaaattttattaggataaatttgagaaacttacgtatatcttaattctgggttgcttgttttttaggtgacaaaaataaaatattgtattttaattc

SEQ ID NO: 466 - DNA, 1234 bp, Homo sapiens
cagccccctctgcggctgccgctgccgggcgggcccgggcgcccgggggctggggggtgggggaggacgccgagcgttgaggcaggggcccgggccgagggcgcggcggggctgcgcgcacgatggggcgcgtggaggggcgcggagggcgaaatgagtctggtaggtggttttccccaccacccggtggtgcaccacgagggctacccgtttgccgcggccgccgccgcagctgccgccgccgccgccagccgctgcagccacgaggagaacccctacttccatggctggctcattggccacccggagatgtcgccccccgactacagcatggccctgtcctacagccccgagtatgccagcggcgccgccggcctggaccactcccattacgggggggtgccgccgggcgccgggcccccgggcctgggggggccgcgcccggtgaagcgccgaggcaccgccaaccgcaaggagcggcgcaggactcagagcatcaacagcgccttcgccgaactgcgcgagtgcatccccaacgtacccgccgacaccaaactctccaaaatcaagaccctgcgcctggccaccagctacatcgcctacctcatggacctgctggccaaggacgaccagaacggcgaggcggaggccttcaaggcagagatcaagaagaccgacgtgaaagaggagaagaggaagaaggagctgaacgaaatcttgaaaagcacagtgagcagcaacgacaagaaaaccaaaggccggacgggctggccgcagcacgtctgggccctggagctcaagcagtgaggaggaggagaaggaggaggaggagagcgcgagtgagcaggggccaaggcgccagatgcgacccaggactccggaaaagccgtccgcgctccgctctgaggactccttgcatttggaatcatccggtttatttatgtgcaatttccttcccctctctttgaccccctttgaggcatctgctccccgtctccccctccaaaaaaaaagtggatatttgaagaaaagcattccatattttaatacgaagaggacactcccgtgtgcaggccgaatcagacccggcgtgggcgaattcagaagtgcccaggtagagacaagctagaggctctgcggacttctgcgggcggtgacaaccgcgagggcgaggggagaaagtcatcaggtcctagacgtgggagaaggagcctaccaaagtgttggagtaaac

SEQ ID NO: 467 - DNA, 1831 bp, Homo sapiens
atgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgtcgccttgttcccttgtaatgaatgcgctaagctcatcatccaggcaggtataaaagaagtgattttcacgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttaggatttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatct

SEQ ID NO: 468 - DNA, 2392 bp, Homo sapiens
agtgggcggttcggcggctctgggcgctgttgtttggtctttaggcctgcggaggggcgttatctggagggccgcgggtgcaggccgcagtgacagggccgctcgccccgctagtcctgcctgtctcccggtgcagctgtgttcgcggcctgcaggcccaacatggcgcaggaggtgtcggagtacctgagccagaacccgcgggtggcagcctgggtggaggcgctgcgctgcgacggcgagactgacaaacactggcgccaccgccgggattttttgcttcgcaacgccggggacctggcccccgctggcggcgctgcctccgctagcacggatgaagctgccgacgccgagagcgggacccgaaaccggcagctgcagcagctcatctccttttccatggcctgggcgaaccacgtcttcctcgggtgccgataccctcaaaaagttatggataaaatacttagtatggctgaaggcatcaaagtgacagatgctccaacctatacaacaagagatgaactggttgccaaggtgaagaaaagagggatatcgagtagcaatgaaggggtagaagagccatccaaaaaacgagttatagaaggaaaaaacagttctgcagttgagcaagatcacgcaaaaacctctgccaagacagaacgtgcatcagctcagcaggaaaacagttcaacgtgtatagggtcggccatcaaatcagagagtgggaactcagctcggagctctggcatctccagtcagaatagctctacaagtgatggagatcgatctgtttccagccaaagcagcagcagcgtttcctctcaggtaacaacggcaggatctgggaaagcttctgaagcagaagctccagataaacacggttctgcatcatttgtttccttgctgaaatccagtgtgaatagtcacatgacccaatccactgattctagacaacaaagtggatcacctaaaaagagtgctttggaaggctcttcagcctcagcttctcaaagcagctcagagatcgaggtgcccttgttgggctcctcaggaagctcagaggtagaattgccactattgtcttccaaacctagttcagagacagcttcaagtgggttaacttccaaaactagttcagaggcaagtgtttcatcatcagttgctaaaaacagttcctcatcaggcacatccttactgactcccaagagcagctcttcaacaaatacatcgctgctaacttccaagagcacttcccaggtagctgcatcactactagcttccaagagcagctcccagaccagtggatctctggtttccaaaagcacttccttagcaagtgtgtcccagttggcttctaagagtagttctcagactagcacctcacagttgccttctaaaagtacttcacagtcaagtgagagttctgtcaaattctcttgcaagttaaccaatgaagatgtgaaacagaagcaaccttttttcaatagactatataaaacggtggcatggaagttggtagctgttggtggctttagtcccaatgtgaatcatggagagctcctaaatgcagctattgaggctctgaaagcaacactggatgtattttttgtcccactaaaagaattggcagatctgcctcaaaataagagctctcaagaaagtattgtttgtgaattgaggtgcaagtctgtgtatttgggcactggctgtggaaaaagcaaagaaaatgcaaaagcagttgcatcaagagaagcattgaagttatttctcaagaaaaaggtggtggtaaaaatatgtaaaaggaaatacagaggcagtgaaatagaagatctagtactccttgatgaagaatcgaggcctgtaaacttacctccagcactaaaacatcctcaagaattactataatgtgtccaaaatatcactgcatacaatatctggtatttgaagagaaaaactgacttttgtatagtataaaacacaggctttcacaaattttgtattgctttttttccagttttgcagaaaatttacattctagttctcttcacacagtagcagttgtaaataatttatgaatgacagtacacattaaaaggtatgcattagcagcatattagtatgctgttttatttgctgaagaaaatactgtcttctatttttaatgatacattaggtacgatgtgtagttcggtagagtcccaaaatttttgtactactttcaatttggtgaaaatgtattaagttgtctaccatgttttcttttctagctgaataaaccacatcaaaggaaagggaccacagtatttgaatgtttgaaagtctgtaaagcttaaggttttaaaaatgttgcccgtaatgttgaacgtgtctgttagaaaaaaaaaaaaaaaaa

SEQ ID NO: 469 - DNA, 2223 bp, Homo sapiens
tctccttgttttgctttcgatctggactgttctcaggcaagccggggagtaacttttagttttgctcctgcgattattcaactgacgggctttcatttccatttcacacaccctagcaacacttataccttgcggaattgtattggtagcgtgaaaaaagcacactgagagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaaccgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaagcaagaaccagttgagtcatctctggggcttagtaatggagtaagtgatctttctcctgagtatgcggtcctgacttcaactataaaaaatgaagtggatagtacggtgaacatcatagttgtaggacagtcccatctggacagcaacattgagaatcaagagattgtcaccaatccgccagacatttgccaagttgtagaggtgaccactgagagcgacgagcagccggtcagcatgagcgagctctaccctctgcagatctcccccgtgtcttcctatgcagaaagcgaaacgactgatagtgtgcccagcgatgaagagagtgccgaggggcggccacactggcggaagaggaatattgaaggcaaacagtacctcagcaacatggggactcgaggctcctacctgctgcccggcatggcgtccttcgtcacttccaacaaaccggacctccaggtcaccatcaaagaggagagcaatccggtgccttacaacagctcctggcccccttttcaagacctccccctttcttcctccatgaccccagcatccagcagcagtcggccagaccgggagacccgggccagcgtcatcaagaaaacatcggatatcacccaggcccgcgtcaagagctgttaagcctctgactctccgcggtggttgttggggcttcttggctttgttttgttgtttgtttgtattttatttttttctctctgacacctattttagacaaatctaagggaaaaagccttgacaatagaacattgattgctgtgtccaactccagtacctggagcttctctttaactcaggactccagcccattggtagacgtgtgtttctagagcctgctggatctcccagggctactcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcccatcccatcccatcccatcccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacatttttttttaattttgtaaaggtgaaaaaagcttttatgagctcatctagcaatcagattttcctgtgga

SEQ ID NO: 470 - DNA, 5155 bp, Homo sapiens
gcatcatggaatgatataaaaatgcagctttccaatcacactaagggtctctctatttcttctcttgaccaccaatcaggaacctttgctggaagcttgtttctgattggtgaaagtaagccataacagtggaatgccaaggagtaaatacaaaagtgtagcaacaattgagtttgctgtctcactaccctcagcctaggccaacctggactccttcaccccaaatgaggtgaccgctacattttatatgaagacactgatttaccattcaactgtgatccatcttataacatggcaatccaatacagacaggaagataaaactcaacaacagctaaaataaagtgtattcccaggtaaaatagacaagtgctttaatttgaaatggattcgtctgatgagtgtcagttacaagggcagagaaggtaccagtgcagaagagctctgactgtgggcagtgtcaccaggtcccactaagtggcaacacttgtgctgggcgacttgacccatcttgatgtataaacccatagccagacaggacgtgcaaacaggtctcatggtgaatgcgatgctgtggaaaatgacatggagaatggctgtctctcagctagggaggagggtcttggtgtcctaggaaagaatgttcacgtcctggagttggtggttggtgttctatctaggcgatgagagaaggatgcttttcctaatgagcacctggtgggaatagagtctctctttgcacttcgctggaggaagaaatttctaccacttattttttcttcttgcttatagaatacacattgcagaaaaaggatgaagttgaccagtgaaaagttgcccaagaaccccttttatgcctctgtatctcagtatgctgctaaaaaccaaaaattcttccagtggaaaaaggaaaagactgattacacccatgctaatttggtggataaggcattgcagctcttgaaggaaagaatactgaaaggagacactctggcatatttcctacgaggtcaactatattttgaagagggatggtatgaagaagcattagaacagtttgaagaaatcaaggagaaagaccatcaagcaacttaccagctaggagtgatgtactatgatgggctggggaccactctagacgctgagaaaggggtggactatatgaagaaaattcttgattctccatgtcccaaagcaagacacttaaaatttgcagctgcttacaacctcggaagagcttattatgaaggaaaaggtgttaaacgatcaaatgaggaagctgaaagactgtggcttatcgcagcagacaatggaaatcccaaagctagtgtgaaggctcaaagtatgctcgggctgtattactcaaccaaggagcccaaggagttagaaaaggcattttactggcattccgaagcatgtggcaatggaaatctggagtcccagggtgcacttgggctcatgtacttgtatggacaaggcatccggcaggatacggaagctgccctgcagtgcttaagagaagcagcagaacgcggaaacgtctatgctcaagggaatctcgtggagtattactataagatgaaattttttacaaagtgtgttgcattttccaaaaggatcgctgactatgatgaggttcacgacatccccatgatcgcccaggtcacagactgtctcccggagttcatcggcagaggcatggcaatggcatccttctaccacgcaaggtgtcttcagcttggcttgggcatcaccagggatgaaacaaccgctaaacactattattctaaagcttgtcgtctgaatcccgcattggcagatgaacttcactccttacttattcgtcaaagaatttagaccacaatgtatttcaacaaagatcatcaatgctaacacctcacaatgtgtgtatttttacagtagctatgtttggttattttgcacatcacaaattacactatcctgggtattttacaggtgacatgttacttcgttcttgaattcgtacgctgttaagttttgcaacttgaaacctagacacaaggtcaaattgctggaagagtcctcagaggtccacctcttaccctacagactggccgagaccatatcaagtattaaaaccattctatacagcaagtatcgtttatcctttcttaaacaccgagtctccaaaaatacttagtttagctttagtttagtaagttcagaagtagaaacaaacttatttaaaaccatcatttgaaagtttaattctttaaatttgtctcttagttttgtgaattttgaataataatgtttaaattttgtttcggtcatttaaaatttaaattttcagtcatttaaaattttaaaaatttaaaatttcacaaaactaagggtaaaagacatttaaagaattaaacttaaataagtgtgtgcagcatttctacttctgaagttattaaagctaaaactgcgctaagccttttgagacatcctttattcttaaaaagctcataaataattggcttattacatataaacttcaaaaaagtgggttataagacattgctttagaatcttgcccctccaaatcttccctcaaagatcttaatgagtaaaacaactgctacatacatatgcagaatgtgtaatgaaacaaaaagcaattgctatatgaaaatattcgtaagaaaagtaaagcaaattgtttctttgtgcttcagctcattttccatatttttaaaaccctgtggtaaaagcctcaatgaaatcatttacaagaactacaattaaatattgttaaaattagcaaaaggctttccgtatatagatgacatctatgaaggcaaaaggtgacagtaaaaacagtaagatccatatgcataagattgtacaaggctattcatttgtgaaacaaatatacatgtcgaagacaggtctcagagataccttaactattcctttttttataaacatattaaaggatgtggctttattttataaatcacaaccatcccaacagtggatttaaacaagatttctttttagtaatgggaaaatgcaattaatatggaggtgatagtcactaagaactgttgaatggcagaaaagtatttgctctcgttttatgttctggcttgtctgtattgcctgaacttcattttgtctttgtgtaagggaagaaatttcaacagactcgggtttgagatatcctcaaatggtcatgtatttctgtctcaaatctcttaataccacccatgtaacattccttcaaccacttgaagatccaaattcccaactagtattctcttctccacacttaatccagttcctaaagattattattattattattatttttttttttttttttttgagacggagtctcctgacctaatcttagcccggcgcagtggctcacgtctgtaatcccagcactttgggaggctgaggcgggcagatcatgaggtcaggagtttgagaccaggctggccaacgtggtgaaaccccgtctctactaaaaatacaaaaattagccgggcgtgatggcggacgcctgtagtcccagctactcgggaggctgagacagaagaactgcttgaaaccaggaggcagaggttgcagtgagctgagatcgcgcaaattgcactccagcctcggtgacaagagcgagactccatctcaaaaaaaaataaaaagaatcttaaaataggaacataataaaagatcggccctaagtaaagagcactttttaaactgccattaaagatgggtttcagaaatcataaactttgacgtgtgccatacatggtaacatgctatgcttatatgtcttctataaatccaatgcagaatttaaaatttcagtttactctagttaccataaagctaatgctctggcacaagcgagtccctgcaaactaccactgctgaggacagtagtaaaccccttgacctgagactgcggtgagtctgtaactcgagtgcattgagacttccagatcattactcttacacacacacacacacacacatacacacacacacactccttctctaagattccttgtagctgatatctcatggaaaaatgacattttatcataaataaatatagagacaaaataatagtgatctttctcattcgcaatgtaaacttaacagctacagtttaaatgatagcatagaattatgcctaaaatagacatttcccataattgtattgtgataagttcttcaggcttgacaacttcacattgcctctcttccttgaatgtattttatctggtcttttctatatagtcttttgaaggataatttttatcaatagccaactttgggtatttttttaagtgtcaaatatcatcatggtttgaaaaaaggataaaaaagctataactaaaaaaatcttaaggataacatttggtttactaatttttaatcatttatctttcagaacttgtttcttatcaagaagttagcaggtatgatatgtatatcatacgtatataaactggcataggttacatcctagggcatgaggggagtatctttcagggattcaaatggaatttttacctgttacttgtttaattgttttgttttcaatattcttggggattagacaggggaaggtattttattactgcataatagatggtgaaacccaggaaaattaagtacttgtgcatggccccactatcaataacacaaagtctgtactctggatctcccctaatgtccctgtggtctaaacggcttgataatacaaccgagcccctgaagtagctgccctcctctttccgctcccccatctcggccctgcccatactccaagggtcagctcccatctctcctccctaatgcctcacttcaagcactaatttggctctttctgctcactaaaaatcatatattttacagatttattttgtttctggagaaggcagcaaacttttacttccctgcagaagtagttaagtacatagtgttttctctaaaaaggcatttgataaatatttgaacagcctgtagagtttcaacctctttgagatataagtatcttaaatatcatagagcactgtgattcatttttatattttattgctttgaatgctcaaactatgggaaatctttggtaaaaataaagacaataaaatcttcacaataacttt

SEQ ID NO: 471 - DNA, 1559 bp, Homo sapiens
acttttgggcaggtgtcagcgcccgtgtcaccgccacgtcgcggacatggtgatttcagaaagtatggatatactcttcagaataagaggaggccttgatttggcttttcagctagctactcctaatgaaatttttctcaagaaggcactgaaacatgtgttgagtgacctgtcaactaagctgtcttcaaacgcccttgtgttcagaatttgccacagttcagtgtatatatggcctagcagtgacataaacaccattcctggagaactgactgatgcttctgcttgtaagaacatactgcgctttgttcaatttgagccagaagaagatataaaaagaaaattcatgagaaagaaggacaaaaagttatcagacatgcatcaaatagtaaatatagatcttatgctggaaatgtcaacctccctggcagctgtaacgcccatcattgaaagggaaagcggaggacaccattatgttaatatgactttacctgtcgatgcagttatatctgttgctccagaagaaacatggggaaaagttcgtaaactcctggttgatgcaattcataatcaactaactgacatggaaaaatgtattttgaaatatatgaaaggaacatctattgtggtccctgaaccactgcactttttattaccagggaaaaaaaatcttgtaacaatttcatatccttcaggaataccagatggccagctgcaggcctataggaaggagttacatggtcttttcaatctgcctcacgacagaccctatttcaaaaggtctaatgcttatcactttccagatgagccatacaaagatggttacattagaaatccacatacttaccttaatccacctaacatggagactggtatgatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggctctagtcgatgccggggacaaaccagcaacatttgtcggatcgcggcaatggattggatctattgaggtgcagctggtactaaaccaattgatcggtataacgtcaaaaatcctgtttgtcagccaaggttcagaaattgcctctcaaggacgggaactggctaatcatttccaaagtgaaggaactccagttatgatcgggggaggagttttggcccacacaatactaggagttgcatggaatgagattacagggcagataaagtttctgattctagatccacattataccggtgctgaagacctgcaagttattttggaaaagggctggtgcggatggaagggcccagatttttggaacaaggatgcatactataacttatgtcttcctcagcgaccaaatatgatttaaaatatcttggagtcaaagactgcagtagagtggtattataaatttgtgaataaagaatcagtttaatttttcacattaaatcctggttctagtttgaccattt

SEQ ID NO: 472 - DNA, 2056 bp, Homo sapiens
tcgcagacagctcgggggaacagtggcggcttcggccggcggtccttgcgctccccaacagcggcgcgggcgggtgagccgtcggggcacagtcccggtgctcttctgtttctcagtcttcgcgcgaccctcgtgcggtgccacacggggcgggctacgagctgctcatccagaagttcctcagcctgtacggcgaccagatcgacatgcaccgcaaattcgtggtgcagctgttcgccgaggagtggggccagtacgtggacttgcccaagggtttcgcggtgagcgagcgctgcaaggtgcgcctcgtgccgctgcagatccagctcactaccctgggaaatcttacaccttcaagcactgtgtttttctgctgtgatatgcaggaaaggttcagaccagccatcaagtattttggggatattattagcgtgggacagagattgttgcaaggggcccggattttaggaattcctgttattgtaacagaacaataccctaaaggtcttgggagcacggttcaagaaattgatttaacaggtgtaaaactggtacttccaaagaccaagttttcaatggtattaccagaagtagaagcggcattagcagagattcccggagtcaggagtgttgtattatttggagtagaaactcatgtgtgcatccaacaaactgccctggagctagttggccgaggagtcgaggttcacattgttgctgatgccacctcatcaagaagcatgatggacaggatgtttgcacgcctcacgtctcgctcgaacggggatcatagtgaccacgagtgaggctgttctgcgttcagctggtagctgataaggacgcatcgcaaaattcaaggaaattcagaatctaattaaggacgagtgctccagagtcgggtctgctttccaaagtataggacatttgaagaactggtatgctactcactggtgaaggacagtcaggtgaaggactgtaagcccacacaagctcttcttatctctactagaattaaaatgttaagtcaaaaacggctccttttttgcgcctcctagtgaaacttaaccagctagaccatttgagtaccagcatttagttacaaacgtcaaaggcttccggtgctgcttaccttccttttttgttaatgtgcttttatttattaaaaaaaattacaatgaagatgcctgttttgtctctactgtgtactctgatcgtatctttccaaagtgcagactcttgtgaagttttcttaaattgttcactttaaagaaaatgacgtaccaacaatgatttggcttttatattactgtaagatgttataatgttaatgtggatgtagtgcttttactttacagattgattggaataagattattgcatatgaatttacccacaggactctgaatcatgttacccactcccctcacaatgttgtccacttagtgagttgcattgatctatccgtaccaaatgatgttgaataattacatatctttcttgactatactgatttcttattttggtcactattactaaatctctgttaatattctctcttttaactgaaaagggatgggatagaagggtttgcaatgccatattattggtggagggctgttttaacatctttgaagtatggcttgctgaatatctttaccaacatcttgaatatatattctagtgtccacaagatttagcaaaaagataaagcttgggtggaatatcattttaaaatgttcatgttctgttctatattttcttcacctactctccaaatattgtaatgcaaaaagtctcagtaatgatttggtagtattaattttgtggtcattgtttctcttcgataaatttattttcattaaatacttgttagagggttttgaaatgtttttcaaatatgtgaaatgtgaaactgctgtcttttatattaaagtaattaaagaaaatgtattgtgattgaaattattttggcctccacaagatggctctatgagtattcttccagggattctaatatttatttaaggtaataaaatcttgacatttataatctttc

SEQ ID NO: 473 - DNA, 3247 bp, Homo sapiens
gtctggacttgtggtgcgctgccagggatccgcagcgttgccggttgtattcgctggataccagagggcggaagtgcagcagggttcagctccgacctccgcgccggtgctttttgcggctgcgcgggcttcctggagtcctgctaccgcgtccccgcaggacagtgtgtcaggcgggcagcttgccccgccgccccaccggagcgcggaatctgggcgtccccaccagtgcggggagccggaaggaggagccatagcttggagtaggtttggctttggttgaaataagaatttagcctgtatgtactgctttaactcctggaagaatgacagatgacaaagatgtgcttcgagatgtgtggtttggacgaattccaacttgtttcacgctatatcaggatgagataactgaaagggaagcagaaccatactatttgcttttgccaagagtaagttatttgacgttggtaactgacaaagtgaaaaagcactttcagaaggttatgagacaagaagacattagtgagatatggtttgaatatgaaggcacaccactgaaatggcattatccaattggtttgctatttgatcttcttgcatcaagttcagctcttccttggaacatcacagtacattttaagagttttccagaaaaagaccttctgcactgtccatctaaggatgcaattgaagctcattttatgtcatgtatgaaagaagctgatgctttaaaacataaaagtcaagtaatcaatgaaatgcagaaaaaagatcacaagcaactctggatgggattgcaaaatgacagatttgaccagttttgggccatcaatcggaaactcatggaatatcctgcagaagaaaatggatttcgttatatcccctttagaatatatcagacaacgactgaaagacctttcattcagaagctgtttcgtcctgtggctgcagatggacagttgcacacactaggagatctcctcaaagaagtttgtccttctgctattgatcctgaagatggggaaaaaaagaatcaagtgatgattcatggaattgagccaatgttggaaacacctctgcagtggctgagtgaacatctgagctacccggataattttcttcatattagtatcatcccacagccaacagattgaaggatcaactatttgcctgaacagaatcatccttaaatgggatttatcagagcatgtcacccttttgcttcaatcaggtttggtggaggcaacctgaccagaaacacttcgctgctgcaagccagacaggaaaaagattccatgtcagataaggcaactgggctggtcttactttgcatcacctctgctttcctccactgccatcattaaacctcagctgtgacatgaaagacttaccggaccactgaaggtcttctgtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaataaagcctctaaatatgttttgtcatttaataacatacagttttgtcacttttcaagtactttctgactcacatacagtagatcactttttactctgtgttaccattttgactggtcgtcattggcatggggtggatatagggcataggattacttgtctcagaagctgtcatagaatttcttgctgccaattaaaaaacctgtgttctttacacactacacgtataaatattgtaactgttcatctttgttgttttatcactgtaagcctgtcaaatcatagtatcctaagcatctgtaaatgctaattttgcatttttggaaaaacccattccttccaagctagtgtttttcattggctccaggtctaatttttcactgtggtccctggcagccagtcttttgaagtttaaagattacctgtctcttgactgcagtaccttttctttaatttttaccaaaaatatccagaggttactggagttcttattcaatataaggaaagtttgctgcactttattaccaagcctctgggattttaccagtcaaacatatttgtgcattacatttcatttcttgtgagctagctggctgtccatattgaatgttgacccatttgagtacgctaaaaggcttacagtatcagacacgatcatggttttagatcccataataaaaatgratgtttttcttataaaaaattatacaaatgctgaagtgagattctactattgttcattgcttccttttctttttccttttgcgattttcactgattaatagcacatttcttcacaaaattagataaagttggtcaaagaccagatattctggaatggaaattgtaaagcttaatcaaaaagaatagccagtacagcatacaatctcagaaacttagaagcaagtagaaaataattggttgatgtaaacgaaagtgccattttagtaaaggcaggaaaaaaatagcaatatttgagttatgtaaggataaaaaatccactgacttgtatttttgcacaagaggctggtctgaatatgattgttcacattaagagtgtttattcgtcggttcattttggggattttcccccttgatgttttgacagattgaagtgagctttagtgagcaaaaggatcagaatgcagggaacactaagctgtgatgaagaaagtgtggtaaaaagccagagtagttttatacagacaaaaccagtgtcaggcctttgcagtaggcttgagtgaacttctgatctagatttgaaagtaaattttatgaagacattgcccatttttacttcctcattcattattgtaccagcatcatagctttattactctaatcccaggtaagtcaagcctacaatgccctagaggaagagtaaaaccagaaattcatgctggcttaaataatctatttttgtttcttttcatttgaatatttaaattttatggtttattaaaaaattaaataaaaaagaaaaaaaaaaaaaaaaaaaactcga

SEQ ID NO: 474 - DNA, 3244 bp, Homo sapiens
agtgacaattaaagatggctgcgcccatgtaacatcactagcgaccggtgacctctttttcccccttgcctggctcctgtggtggcaggctgggcacgaggaccatgctgggccggagcctccgagaagtttctgcggcactgaaacaaggccaaattacaccaacagagctctgtcaaaaatgtctctctcttatcaagaaggccaagtttctaaatgcctacattactgtgtcagaagaggtggccttaaaacaagctgaagaatcagaaaagagatataagaatggacagtcacttggggatttagatggaattcctattgcagtaaaagacaatttcagcacttctggcattgagacaacatgtgcatcaaatatgctgaaaggttatataccaccttataatgctacagtagttcagaagttgttggatcagggagctctactaatgggaaaaacaaatttagatgagtttgctatgggatctgggagcacagatggtgtatttggaccagttaaaaacccctggagttattcaaaacgatatagagaaaagaggaagcagaatccccacagcgagaatgaagattcagactggctgataactggaggaagcccaggtgggagtgcagctgctgtatcggcgttcacatgctacgcggctttaggatcagatacaggaggatcgaccagaaatcctgctgcccactgtgggcttgttggtttcaaaccaagctatggcttagtttcccgtcatggtctcattcccctggtgaattcgatggatgtgccaggaatcttaaccagatgtgtggatgatgcagcaattgtgttgggtgcactggccggacctgaccccagggactctaccacagtacatgaacctattaataaaccattcatgcttcccagtttggcagatgtgagcaaactatgtataggaattccaaaggaatatcttgtaccggaattatcaagtgaagtacagtctctttggtccaaagctgctgacctctttgagtctgagggggccaaagtaattgaagtatcccttcctcacaccagttattcaattgtctgctaccatgtattgtgcacatcagaagtggcatcgaatatggcaagatttgatgggctacaatatggtcacagatgtgacattgatgtgtccactgaagccatgtatgctgcaaccagacgagaaggatttaatgatgtggtgagaggaagaattctctcaggaaactttttcttattaaaagaaaactatgaaaattattttgtcaaagcacagaaagtgagacgcctcattgctaatgactttgtaaatgcttttaactctggagtagatgtcttgctaactcccaccaccttgagtgaggcagtaccatacttggagttcatcaaagaggacaacagaacccgaagtgcccaggatgatatttttacacaagctgtaaatatggcaggattgccagcagtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacaggaggaaatgcaaccagtcagggcccagaatcatgcaaatctcaggggtatgcctctctggggaggagctccacttgcagggactccttttatttccctaagaaagagctgaaatgactgagaactttcctttcctccttagagttacaattttacttctgctattccggagcccatgcctagaagccagaacaactccatgttacactgagttcatgctcctatttactgatcacaaatgagctcattaatgtcatcgaaacatttattgtaacctaacagaccatcacagattggaaacttggtagatagcagagcatggtattagtgaaaaaggttcaaaatacacaagtaacatacactctgaaaaacatgcagataatttgctgatgaagcagaagaggggatgcgcatggcaagaacttgccttaccccagattctctatatctcatggtttccttttcctcttgactgtctttacgagtgttttttatttgggaccctcgagcccagagatattaatggatatctgtattcaatatttgacaaaatctaatggaaaccatccatttactcatgataaggcttcatcactggatttctgtgtcttcactagaacaccattgtcatctcatattgatcaggtattttaatctagcacttacatattgttgataaatgaaagctgaattgttacttaataaattcactttgtttagcaaaaaaaaaaaaaaaaaaa

SEQ ID NO: 475 - DNA, 3553 bp, Homo sapiens
ccacgcgtccggcgtcctccacataggcagtggctgtggtttctaccccgggtggccgggggcagtgctgagctgggactgttgtttgcccagcctgggctgcagaaagcagcagttaaagttcgtttctggtcactgctccaggaagccaccttactctgagggtcaagaattgccgcttccttttagttactgtaagttcctcctctgcccctggtttgtttcccgcggcacttctggatacccccaggtcccagacccttccagactcaaaccatgaactttcggcagctgctgttgcacttgccacgttatcttggagcctcgggttccccgcgtcgcctgtggtggtccccgtccctcgacaccatctcctcggtgggctcttggcgtggtcggtcctccaagtccccggcccactggaatcaggtagtgtcagaggcggagaagatcgtggggtaccccacgtccttcatgagccttcgctgcctgctgagcgacgagctcagcaacatcgctatgcaggtgcggaagctggtgggcactcagcaccctctgcttaccacagccagggggcttgtacatgacagctggaatagcctccagttgaggggcttggtggtgctccttatctctaaagcagctgggcccagcagcgtgaacacttcatgtcagaactatgacatggtcagtgggatctactcatgtcaaagaagtttggcagagatcacggagctaattcatattgctctccttgtacatcgtgggatagtaaatttaaatgagttgcaatcatctgatggtccactgaaagacatgcaatttggaaataaaattgctatcctgagtggagactttcttctagcaaatgcctgcaatggactagctctgctacagaacaccaaggttgtggaacttttagcaagtgctcttatggacttggtacaaggagtatatcatgaaaattctacttcaaaggaaagttatatcacagatgatattggaatatcgacttggaaggagcagacttttctctcccatggtgccttactagcaaagagctgccaagctgcaatggaattagcaaagcatgatgctgaggttcagaatatggcatttcagtatgggaagcacatggccatgagtcataagataaattctgatgtccagccttttattaaagaaaagaccagtgactccatgacttttaatctaaactcagctcctgtagtcttacatcaggaatttcttggaagagatttgtggattaaacagatcagagaggctcaagaaaaaggaagattggactatgctaagttgcgagaaagaatcaaagctggcaaaggtgtgacttcagctattgacctgtgtcgttaccatggaaacaaggcactggaggccctggagagctttcctccctcggaggccagatctgctttagaaaacattgtgtttgctgtgaccagattttcatgacatcaaattaaaaagacactattgttagttagctgaaaatcctagggaatgaggttgattgggagcgctttcacgatgcgttaatgacttttaaaacatatgcatttttccttccttttatcacattgctaaatgagttctgctttctttttggaactgctacaaacaaaattagaagaaaaaaaggtcaagcagttttcacttgtcacgccagaagcacacttgaggctgcagtcgcagaaataattaatgagattcgctcctgtgacctcagcaaatggacaggaaataagtccttattgattggaccgagccagggatggcgccagggcggtggcctgtggtttttcctgctagagaggacaaagcaagttggaagctgcaggtgtcaagagaaatgctctcaataccaaccagggaggattgtctaatcaaaaactagtgaccaatttgtcataatggagagtagttcaatggattgagaaaaatatgttttatttgttggcttgtaattatgtctctggattattattattttttttttagatgtagttttgctcttgttgcccaggctggagtgcaatggtgcagttttgactcactgcaacctccgcctcctgggttcaagtgattctcctgcctcagcctcccgagtagctggaattacaggcacctgccaccacgcctggctaattttgtatttttagtagagatggggtttcactatgttggtcaggctagtctcgaactcctgacctcaggtgatccgcctgcctcggcctcccaaagtgctgggattagaggcttgagccactgcacctggcctcatgtctctggatttataatgcagtatgaatatactttgtgctttatggtttttataatgtctttttggagaaattgccgaaaagttgccaaatacttgaagtaggagattaaaatgttatcaaatgttaaattggttatattaggaatagtctgtttttctttcctgaagatcagtttttttattcaaacacatttcaaagaaccaaatttttttttttctttaaggaaaaaggagctttttttcaagtgaaatgtattcatttgtaatactttggtttaaggcatactttaatttttacgagtttcagaaacagaatttttgtactagggaattcattggtgagagtgttcttttaacctcagaatgtcaaattttggtcttgaaccacagacatccaattacagaaagaatataagcaatctcacaggcctgcaatcggacactgtctctgtgtggttcataggagatgatttttgaggtttgcactcatgcaatttgagaacaccgttgacaagaaggctgagtttacataaatgatctagattgaaactcagctacctttcttcctcatgtggtgtaattacagccctatctggagacagcgaatacagcaaacagattttattacctagttcgctcaaacactacatgaagttattttagttaaagccctcccccaaaagttataaaaccattttatcagggcccaacatgtggcatgcaatgaagagaaaatgtaaagctacagaggttaatgtattgtattataaaatattttaagtgtactcaaaatatcataattgtacagtttatgccaccataatttgaggcctatagatttagcttaagagaacactgttctgtttgaaatgctttctgtcactgaaattggcttaattagtaaccatggataagatgctttagatcagactaggttttaatcattaacttccacaaagaagtcatactttgcgttaggtgtgctggttggatgtgcaggaacttcagcaagcagtaggttttactaagcagatggtcgggcactgcagggcaccaggcaggatcctagggcgcctcttattctgcgttagcatctggtttgctgtatgaccttgcacaagtcacttccttctgagcctcaattttctcatctgtacaatgagattcaaaagttgacctgaaagtcaagtgtgaaaaaaaaaaaagagattaaacaagataattatgaaattcaaaaaaaaaaaaaaa

SEQ ID NO: 476 - DNA, 3368 bp, Homo sapiens
gtgggggcggggaggagaggcggcggcggcagtgtccaagctacgccactcgggctggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaattcaattctggttttacttgtatatggattggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagagtggcaagaattacaacaaagcatacagcgaaaagagagagctctattggaaaccaaatcaaaaataacacatcctgtgtatagcctttactttcctgaggaaaaacaagaatggtggtggctttacattgcagataggaaggagcagacattaatatccatgccatatcatgtgtgtacgctgaaagatacagaggaggtagagctgaagtttcctgcaccaggcaagcctggaaattatcagtatactgtgtttctgagatcagactcctatatgggtttggatcagattaaaccattgaagttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttgaaagtgtatcataaaccagaacagtacagaactgatgttgaggaaggtgtagtttttttactctagaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgtaaaaaaaaaaaaaaaa

SEQ ID NO: 477 - DNA, 1496 bp, Homo sapiens
gtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgcaaaaaaaaaaaaaaaaaaaaaaaaaaaaaaaaaa

SEQ ID NO: 478 - DNA, 1387 bp, Homo sapiens
ctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgcaaaaaaaaaaaaaaaaaaaaaaaaaaaaaaaaaa

SEQ ID NO: 479 - DNA, 1572 bp, Homo sapiens
gtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaagccctgcctcagaatgacatcagaggcaaggagtcatggaaggacgtggtgtgctcagaatgatgaaaagttattttgtgactagaaagtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgcaaaaaaaaaaaaaaaaaaaaaaa

SEQ ID NO: 480 - DNA, 1496 bp, Homo sapiens; identical to SEQ ID NO: 477

SEQ ID NO: 481 - DNA, 1387 bp, Homo sapiens; identical to SEQ ID NO: 478

SEQ ID NO: 482 - DNA, 1572 bp, Homo sapiens; identical to SEQ ID NO: 479

SEQ ID NO: 483 - DNA, 3026 bp, Homo sapiens
tcgacccacgcgtccggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggcttttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaaaaaaaaaaaaaaaaaaaa

SEQ ID NO: 484 - DNA, 1662 bp, Homo sapiens
gcggccgcgaccgccggggacgagcttggaggaaaaggaaccgggagccgcccacccgggggcgctctccggacccccagggtcctagcgcgcggcccttaccgagcctgggcgcccggatttcggsagcggatcgcctttccgggttggcggcccgcctgattgggaacagccggccggttgccgggggaacgcgggagtcgggcccgacctgagccacgcgggcttggtgcccacctgtgcgcgccgcctgcgaagaaggaacggtctagggagaaggcgccgccggccgcccccgtccccaccgcggccgtcgctggagagttcgagccgcctagcgcccctggagctccccaaccatgaagctcaacttctccctgcgactgcggatcttcaacctcaactgctggggcattccgtacttgagcaagcaccgggccgaccgcatgaggcgcctgggagactttctgaaccaggagagcttcgacctggctttgctggaggaggtgtggagtgagcaggacttccagtacctgagacagaagctgtcacctacctacccagctgcacaccacttccggagcggaatcattggcagtggcctctgtgtcttctccaaacatccaatccaggagcttacccagcacatctacactctcaatggctacccctacatgatccatcatggtgactggttcagtgggaaggctgtggggctgctggtgctccatctaagtggcatggtgctcaacgcctatgtgacccatctccatgccgaatacaatcgacagaaggacatctacctagcacatcgtgtggcccaagcttgggaattggcccagttcatccaccacacatccaagaaggcagacgtggttctgttgtgtggagacctcaacatgcacccagaagacctgggctgctgcctgctgaaggagtggacagggcttcatgatgcctatcttgaaactcgggacttcaagggctctgaggaaggcaacacaatggtacccaagaactgctacgtcagccagcaggagctgaagccatttccctttggtgtccgcattgactacgtgctttacaaggcagtttctgggttttacatctcctgtaagagttttgaaaccactacaggctttgaccctcacagtggcacccccctctctgatcatgaagccctgatggctactctgtttgtgaggcacagccccccacagcagaaccccagctctacccacggaccagcagagaggtcgccgttgatgtgtgtgctaaaggaggcctggacggagctgggtctgggcatggctcaggctcgctggtgggccaccttcgctagctatgtgattggcctggggctgcttctcctggcactgctgtgtgtcctggcggctggaggaggggccggggaagctgccatactgctctggacccccagtgtagggctggtgctgtgggcaggtgcattctacctcttccacgtacaggaggtcaatggcttatatagggcccaggctgagctccagcatgtgctaggaagggcaagggaggcccaggatctgggcccagagcctcagccagccctactcctggggcagcaggagggggacagaactaaagaacaataaagcttggccctttaaaaaaaaaaaaaaaaaa

SEQ ID NO: 485 - DNA, 3697 bp, Homo sapiens
cccaagactgtccccgctggaggcggtagagggatccagaagtaatgagatgctaatgagtcgcgaataaagcccgggcggcgccccgcgcccctcgcggaagcccacactccgcgcgactccaggcgcacgccccgggccgccccgcatcccagcatccccgcccgatctcggcgtttccgcccccgcccccgcccccgccctcccacccgctcagacctggttgccagcccaacaggaagcggcccctcccggcttcggagccgccgccactcgtctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacaggcattgatctggagaacattgtgtactacaaggacgacacccactactttgtgatgacagccaagaagcagtgcctgctgcggctgggggtgctgcgccaggactggccagacaccaatcggctgctgggcagtgccaatgtggtgcccgaggctctgcagcgctttacccgggcagctgctgactttgccacccatggcaagctcgggaaactagagtttgcccaggatgcccatgggcagcctgatgtctctgcctttgacttcacgagcatgatgcgggcagagagttctgctcgtgtgcaagagaagcatggcgcccgcctgctgctgggactggtgggggactgcctggtggagcccttctggcccctgggcactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccgggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctatgagcagcacccaggagatggacatttctactgcctccagcacctgccccagacagaccacaaaaaggaaggcagcgatagaggccctgagagtccggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcttggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccccaaaaaaaaaaaaaaaaaaaaaaaaaaaaaaaaaaaaaaaaaaaaaaaaaaaaaaa

SEQ ID NO: 486 - DNA, 5597 bp, Homo sapiens
cgcgcttccgggttggctgtggctgtggctgcggcggcggcgcaggagcagaaaccggtgcggcgcagaagccccagaggcgggcggggcggagcggagggccagcgggccccggcgtgggtctcccgccaggccgccggatttaacccttagtggcttctgaagaaaatggcagaaacatcgccagagccttctgggcagcttgttgtacactcagacgctcacagtgacactgtgctggccagttttgaggatcagaggaagaaaggcttcctctgtgacattactttaatcgtggagaatgtacatttccgggcccacaaagccttacttgctgccagtagtgaatacttctcaatgatgtttgcagaagagggggaaatcggccaatccatttatatgctggaaggcatggttgcagacacctttggtatcctgctggaatttatctacacaggttatctccatgccagtgagaaaagtacagaacaaatcctggctactgctcagttcttaaaagtctatgacctggtaaaggcttacacagacttccaaaataatcatagctccccaaagccaacaactttgaacactgctggtgccccagtggttgttatctctaataagaaaaacgatcctccaaagcggaaacggggaagaccaaaaaaagtcaatacattgcaggaggagaaatcagaactggctgcagaggaagaaatacagttaagagtgaacaattcagttcagaatagacaaaactttgtggttaaaggagacagtggtgtactgaatgagcaaattgcagcaaaagaaaaggaagaatcggagcctacttgtgagccaagtagagaggaggaaatgccagttgaaaaagatgagaactatgatcccaagaccgaggatggccaggcaagccagagtcgatacagcaagcggaggatttggagatccgtcaaacttaaagattacaaacttgttggggatcaagaggaccatggttcagccaagaggatctgtggaaggagaaagcgccctggaggccctgaggcccgctgtaaagactgtggcaaggtctttaagtacaatcactttttagcaatccaccagaggagccacacaggggagcgacctttcaaatgtaatgagtgtggaaaaggctttgcccagaagcactcgctacaggtccacaccaggatgcacacaggcgagcggccgtacacctgcaccgtgtgcagcaaggctctgaccaccaagcactcactgctggagcacatgagcctgcactcaggacagaagtcttttacctgtgatcaatgcggaaaatatttcagccagaacagacagctaaagagccattaccgagttcatacaggccactcattaccggaatgcaaagactgccatcgcaaattcatggatgtgtctcagctaaagaaacatctgcgaacacacacaggtgagaagccatttacttgtgaaatctgtggcaaatctttcacagcaaagagttctcttcagacccacatcagaatccatcgaggagaaaagccatactcctgtggcatttgtggcaaatccttctctgactccagtgccaaaaggagacactgcattctacacactggcaagaagcctttctcctgccctgagtgtaacttacagtttgctcgcttagacaacttgaaggctcacttgaaaattcatagcaaggagaagcatgcttcagatgccagcagcatttctggcagtagtaatacagaagaggtcaggaatattcttcagctacagccatatcaactctctacctcgggagagcaggaaattcagcttctcgtaaccgattctgtacataacatcaatttcatgcccggtcctagccagggaatcagcattgtgactgcagagagttcccaaaacatgactgcagaccaggctgctaatcttaccctgctcacgcagcagccagagcaactgcagaatttaattctttcagctcaacaggagcaaacagaacacattcagagcctcaatatgattgaaagccagatggggccctcacaaacagagccagtgcacgtgatcactctgtccaaggaaacactggaacatcttcatgcccatcaagagcaaacagaggagctccatttagctacaagtacttcagatccagctcagcacctgcagctgacacaggagcctggtccgccaccacccactcaccacgtgccccagccaacgccacttggccaggagcagagctgacctgtaaacacgtttgactgcttgattgggctcttcttataagccagctctgactggattttgaacgcttgaaatcaggctctccacaccattgacttgcagatgcttctgtgagagctgtgatggctaactgatgtttataatgccctccatccaggtagcaagatgtgtgtatgtcttgtctaaggtactgatttgtattgagcatttcaatattattgaatggttttcattttaatctgcaatgtctcataaagactcgggtagtttttctttgggggcattgatctcagtttttctgtaaggtttaaatgttcacagccataggttatggtcttgccaacctccccagttatgtttttttgttttctaggacaaagggagtcattttggttgaactgggcagaatggtttgttctattttcttatttttcttaggcaacacagttgttaccacaagacaagtcagggctaaatatgacagatcacaatgtatggggaatttgcccttttaataatttccagtcccctaagacaaagtaaccctcaacgttttatctttatgcagtacagtgggcttattgtgttaacacttcagaaagattcaaactcataaactcagtattttaactcaaaattcatgtaacaagatagccaaaagcataggatttcttaaaattctgaattcgtcttttctgagaaacataaatttacatatttttcaacagaaggctatcaaaattttaattaagtttaaaatacaaaattggatcaagacattcaccctaaattctgaatttttgtcagaaaagagatttgattttcatgaaggtaaagctttcttcactattctggaacataaaactttattcagtgtaatttaagtcttatatatactctactgaattctaactgatctcctgaaaatgttgatctacgtgttgtgtctgataactttctggagatggaagcttataattcatttttattgcagactagttaaatcccacaaagtgaatatcttctcctaatctttccttttttagagacagggtctcactgtatcacccaggccagagtgtagtggcacaatcattgctcactgtaacctcgaattcctgggctcaagcaaccctcccaccttagcctccctagtagctgggactacagggatgtaccaccacacccagctaatcttcatctaatcttaaaactttgagcctcagagactttgtagccagcatgtgtctgtaattgtatgatttttaaatcatcatcaaaagattaaattatgtttgggttaggttttcaagctaagcttattgaattcttttaccactttcatgtaagctggtaggggatttttgagaaaagaaggtgggcactagtatatctaaattaacaatgctgatggggagtagggggtaatctactctaaaattaatagagcctttccatcaattgttttgttttagacatccttgatttctccctaaatcaaataagttatttggaggttagagtaatagagaattcttcaggtttgagagaagataaaaacattttggttgcatatttgctaagctatattttattatatgtaattcacaaaacttccaaaatgatatatatcttatatgtatcaaccaaactaatgttaaatcaggcctgactagagcaaagataacaattttttacaaacactgttaagccctaagtattatttcaggttctcgtttaaactgtttaattttattcttaaaacacaaagtttttaccaacttttcaaagcccaccaatccacattttctccaggaaattaaatatttaagtaagtgagtgtttactcactctggatagctaggtgattattcagaaaatacggttacatagctatttataagtcaagtttcactggctctataacagtctacctctacactaagagaactataacatgaacaacataggtcactttaaatgttctagtagcaacttttaaaaacataaaaagaagcaggtgaaaatgttaataaaagtttatttaatccaacatttgccaaatatttcaacatataaaaatatattagtgagacattttacattctctttttcatactaagctttcgaaatctggtgtgtattttacactttctgcacatctccatttggatgctaatgttcattggacatacttgatctgtatttagatttcatacaacttacagttgaaaacagattctcatatcaagtagctaagacaaaagtttttttcaagaattgaaataagtatcagtttaaaaatttatattaaatttattaaaattaaaatccagttccttgttgcatgggacacagtgcaaatgcttgataagcacatgtggctagtggctgctatattggacagcatgggccacctgtttctaacttgagcatcagtcctagctatgcctgaattatttgaccagctgtcaaagagaaacaaggaaatgatagctttgttaatctagcctctttctttgtcccacatatacattctacccctttgaataaaaaagttcaatgacgccgggcgtggaggctcatgcctgtaatcccagcactttgggaggccaaggtgggcggatcacgaggtcaggagttcgagggcagcctgaccaacatagtgaaaccccatctctactaaaaatacaaaaattagctgggcgtggtggtgtacccctgtaatcccagctactcgggaggctgagacaggagaatcacttgaacccaggaggcggaggctgcagtgagctgagatcacgccattgcactcaagcctggcgacagagcgagactccgtctcaaaaaaaaaagttaaatgacttgagtacccaaaagaaatgtcgtgaacatgaaagtacttctcatgtgtccttgagaaatgatgttgctagtgcagtgtttcacaattcattttctactaaatgtgtaccattttttaaattgttttaacagaaatatagagtgtgtttcttaggaaatagaatgttatgctttggggctcctgaaacacctcgttttgaaggtgaatctttggttttctcccagaagagggtctgccttgggatgattggagctcttaccatcaaaatcagttattcaagtgcttgcccagtgcttcttgaaactcacctctactctgtattttctacagttggttcttgtgttataaatgttgtgagcaacagattaaatgatgctgaggaatgaaaaaagattctcattataaatgcttacctaggattctcattatagatgcttatctaggttttcataaatgggaatgtaacaat

SEQ ID NO: 487 - DNA, 3089 bp, Homo sapiens
ggaggcggggcgcagggatccggaaacacctgatcatctataggtttagtgcctaatgggtgttgttcctggctggacttgatgtccagggcctgaggggttttctcgccgagtctcctggggcggtccggaggctcgtgccctgttgtggggcccccatttgccgccgccatgcccacggccgccgcccccatcatcagctcggtccagaagctggttctgtatgagactagagctagatactttctagttgggagcaataatgcagaaacgaaatatcgtgtcttgaagattgatagaacagaaccaaaagatttggtcataattgatgacaggcatgtctatactcaacaagaagtaagggaacttcttggccgcttggatcttggaaatagaacaaagatgggacagaaaggatcctcgggcttatttcgagcggtttcagcttttggtgttgtgggttttgtcaggttcttagaaggctattatattgtgttaataactaaaaggaggaagatggcggatattggaggtcatgcaatctataaggtcgaagatacaaatatgatctatatacccaatgattctgtacgggttactcatcctgatgaagctaggtatctacgaatatttcaaaatgtggacctatctagcaatttttactttagttacagctatgatttgtcccactcacttcaatataatctcactgtcttgcgaatgcccctggagatgttaaagtcagaaatgacccagaatcgccaagagagctttgacatctttgaagatgaaggattaattacacaaggtggaagcggggtatttgggatctgtagtgagccttatatgaaatatgtatggaatggtgaacttctggatataattaaaagtactgtgcatcgtgactggcttttgtatattattcatgggttctgtgggcagtcaaagctgttgatctatggacgaccagtgtatgtcactctaatagctagaagatccagtaaatttgctggcacccgttttcttaaaagaggtgcaaactgtgagggtgatgttgcaaatgaagtggagactgaacaaatactctgcgatgcttctgtgatgtctttcactgcaggaagttattcttcatatgtacaagttagaggatctgtgcccttatactggtctcaggacatttcaactatgatgcctaaaccacctattacattggatcaggcagatccatttgcacatgtggctgcccttcactttgaccagatgttccagaggtttggctctcccatcatcatcttgaatttagtgaaggaacgagagaaaagaaagcatgaaagaattctgagtgaagaacttgttgctgctgtgacctatctcaaccaatttttgcctcctgagcacactattgtttatattccctgggacatggccaagtataccaaaagcaagctgtgtaatgttcttgatcgactaaatgtgattgcagaaagtgtggtgaagaaaacaggtttctttgtaaaccgccctgattcttactgtagcattttgcggccagatgaaaagtggaatgaactaggaggatgtgtgattcccactggtcgcctgcagactggcatccttcgaaccaactgtgtggactgtttagatcgcaccaacacagcacagtttatggtgggaaaatgtgctctggcctatcagctgtattcactgggactgattgacaaacctaatctacagtttgatacagatgcagttaggttatttgaggaactctatgaagatcatggtgataccctatcccttcagtatggtggttctcaacttgttcatcgtgtgaaaacctacagaaagatagcaccatggacccagcactccaaagacatcatgcaaaccctgtctagatattacagcaatgctttttcagatgccgatagacaagattccattaatctcttcctgggagttttccatcccactgaagggaaacctcatctctgggagctcccaacagatttttatttgcatcacaaaaataccatgagacttttgccaacaagaagaagttatacttactggtggacaccagaggtgataaagcatttaccattgccctatgatgaagttatctgtgctgtgaacttaaagaagttgatagtgaagaaattccacaaatatgaagaagagattgatatccacaatgagttctttcggccatatgagttgagcagctttgatgataccttttgcttggctatgacaagctcagcacgtgactttatgcctaagaccgttggaattgatccaagtccatttactgtgcgtaaaccagatgaaactggaaaatcagtattgggaaacaaaagcaatagagaagaagctgtattacagcggaaaacggcagccagcgccccgccgccccccagcgaggaggctgtgtccagcagctctgaggatgactctgggactgatcgggaagaagagggctctgtgtctcagcgctccactcccgtgaagatgactgatgcaggagacagtgccaaagtgaccgagaatgtggtccaacccatgaaggagctatatggaattaacctctcagatggcctctcagaagaagatttctccatttattcaagatttgttcagctggggcagagtcaacataaacaagacaagaatagccagcagccctgttctaggtgctcagatggagttataaaactaacacccatctcggctttctcgcaagataacatctatgaagttcagcccccaagagtagacagaaaatctacagagatcttccaagcccacatccaggccagccaaggtatcatgcagcccctaggaaaagaggactcctccatgtaccgagagtacatcaggaaccgctacctgtgaaaagagcgcaggtccacctggtggacacgtctgattagcttagaacctgtcttgtctcatcttcaaaaggtaacttattaaaagtcctttgcgtctgaagcctttctccttttctgtcacttgcaaattccaaattatagctaataaagatgactagataatttgcaaaaaaaaaaaaaaaaaaaaaaaaaaaa

SEQ ID NO: 488 - DNA, 2625 bp, Homo sapiens
cttctcttgcacttgcggatgatgaactggaataacgatgaaagaaagcacatccgatctcaacattcacgtcctgccctataaccgattaattaattgatccccagctagactagtgttggagaaatcagcatgttaaaacaactgttgatgatagctgttggagtaaagttgcagtggaagctatggctgcaaaatcgttaaaatcttcaaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaagcagaaaaatctagatcgtcctcatgaaccagaaaaagtgccaagagcacctcatgacaggcggcgagaatggcagaagctggcccaaggtccagagctggctgaagatgatgctaatctcttacataagcatattgaagttgctaatggcccagcctctcattttgaaacaagacctcagacatacgtggatcatatggatggatcttactcactttctgccttgccatttagtcagatgagtgagcttctgactagagctgaggaaagggtattagtcagaccacatgaaccacctccacctccaccaatgcatggagcaggagatgcaaaaccgatacccacctgtatcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtatctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagtt

SEQ ID NO: 489 - DNA, 3866 bp, Homo sapiens
ctccgcagaagatttgttgccgtcatgtcggctgcgattgcagctctggccgcttcctatggttcgggttcagggtccgaatcggactcggacagtgagagcagtcggtgtccgctgccagccgccgactccctcatgcacttgactaaatcgccttcatcaaagccgtctctagcagtggcagtggactcggctccggaggtggcagttaaggaagatttggagactggagttcaccttgaccctgccgtcaaagaagttcagtataatcctacctatgagaccatgtttgctcctgagtttggaccagaaaatccctttaggacacagcaaatggctgcccctagaaatatgctttctggatatgccgaaccagctcatatcaatgatttcatgtttgagcagcaaaggagaacttttgcaacatatggttatgcattagacccttcattagataatcatcaagtgtctgctaaatatattggttctgtagaagaagctgaaaaaaatcaaggtttaactgtatttgaaactggtcagaagaaaacagaaaagaggaaaaagtttaaagaaaatgatgcatccaatattgatggttttttgggaccatgggcaaaatatgtggatgaaaaagatgtagccaaaccttcagaagaagagcaaaaagaattggatgaaatcacagcaaagaggcagaaaaaaggaaaacaggaagaagagaaacctggggaggagaagacaatcttacatgttaaagaaatgtatgactatcaaggcaggtcctatcttcacatacctcaggatgttggtgttaatctacggtcaactatgccacctgagaagtgttatcttcccaaaaaacaaattcatgtgtggtctggacacacaaagggcgtcagtgcagtcagattgtttcctctctctggccatttattgctgtcttgttccatggactgtaaaattaagctatgggaggtttatggagaacggcgctgtctgagaacatttattggtcacagtaaggctgttagggatatctgcttcaatactgcaggaacacagttcctcagtgcagcctatgacaggtatcttaagctctgggacactgagacaggacagtgtatatcaagatttacaaaccgaaaagtaccttattgtgtcaaattcaatcctgatgaagataagcaaaatctctttgtggctgggatgtctgataagaagattgtgcaatgggacattcgaagtggagaaattgtgcaggaatatgatcggcatttgggagctgtcaacaccattgtttttgtggatgagaataggagatttgtgagcacatctgatgataaaagcctaagagtttgggaatgggatatccctgtggatttcaagtacatagcagaacccagtatgcactcaatgcctgcagtgactttgtctccaaatggaaaatggctagcatgccaatcaatggacaaccaaatcttaatttttggagcacagaacagatttagattaaataagaaaaaaatttttaagggccatatggtagcaggctatgcttgtcaggtggacttttcaccagacatgagttatgtgatttcaggagatggaaatggaaaattaaacatttgggactggaagaccacaaaactctacagtcgatttaaagctcatgataaagtgtgtataggtgcagtgtggcatcctcatgaaacttctaaggtcataacatgtggttgggatggtctcattaaattgtgggattaatgagattaatccttaaactagctgggatcatttttgatccattgtcatatttatatttaattattaaatgtatctgatgataacttgatttacagataatgttgatgacattgaccctttgtttaaaaaaagaaactgtaaatttgacataatttcatttgcaacttcattttgttttttataaatgttatttatacagaaagtggctattgactttctatttgacaagtagttataattggcaagcagtttgagtttatactcatgacatactgaaagcatctctttggggtcaagaaagaatccctagtggatttgggattctagaggaggtgttataattaattattcagaaaaatgcatgtatttacctcttcaaccaaaagggcagtaaagaatagggataatatattttaatgtaaatttggaagaaggataaaatcacccacagttactctccctattattttcactgggtcaagttttaatcttttggcttcatgagttccactccctttgatgatatatgttgtatatttttagttgtaaagcagtaatctttaactgtagcattcctctaattataaacagtgaaaaatcaaaatcagtccagagttcttttgttgacttaattcctgatcagtatagacaggactatatatatttaatcagagaattacattatatctgaagatggagctcaggagaatgcaccaagactttgaattgtatttacattcactgtcagtaaagacctggctacgctttgagaaatcaggatctcctaggtcattgcttcgcagctgtgattactgaaatcctcctcataggagataaagtacgaggggtagagtccaagatgtcaacttgtaatttctttgaagtcatatgttttatctttaaaattattcttattttacctgtgaatatatacaacagaactttttaagattaaaaaatttttaaacctctatgtctgaaaaaaaaaatgacactcctggaagatggctagggttccccagtttgagaagcagtggccatggtgaaaaatagtttttgaaaacatcagattataaaatcaagatagtccggacgcggtggcacatgcctgtaatcccagcactttgggaggctgaggcaggtgaatcacctgaggtcaggagttcaagaccagcctggccaacatagtgaaaccccgtctctactaaaaacacaaaaattagccaggcttggtggctggcgcctgtaattccagctactcagaaggctgaggcagggagaattgcttgaacccaggagtggaggttgcagtgagctgagatcatgccactgcactccagcctgggcgacagagcgagactccacctcaaaaaataaaatcaagataacctcttgaatgtaatagctcatagcactttaatttggcaagccatttttcctgttttattataaatctatattagatgtttgaatatggtttgaaatatttcactaccgtgctgaaaaaggttggttgatagcagcttggagtgctaactggaagatcaaaatcatgtctcttgctgataacctaagagcattaagctctgagtccagtgaggtcatagcagtgtatgctccttgcccttacggagtgtctgtttttagaaatttagattttaaaaggcgtgggacatacgaccaggccctatagccacataaatataaatttcatagaaaaagaataaaagcggagatatattttttgacacagaggcacccaaagaaatacaaacattgcctagctgctgccatttctgtaactgcccagaagggtgacagatttctgaaggggaaaggattcagatatgaccttttctttagtcccaaccactagttttaacaaatgtgaattattgaaatgtgaagggacaaaaagaatcatacatttaaactgtcttgttcagcataccaatattgtatgttacaaatcatcatttctaaatctggattgattctgttgtgtttttgactgtttctaaagtaagtgtgtataaaagtctcctttttaaaaagatcatatttttaaataaagcattttttgtagaaaaaaaaaaaaaaaa

SEQ ID NO: 490 - DNA, 3196 bp, Homo sapiens
agcggggggggaggaggaggagggactgagcggcggcggcccccgcgtcccgtgcctctatgggggaagcagacaatggattatgatttcaaggcgaagctggcggcggagcgggagcgggtggaggatttgtttgagtacgaagggtgcaaagtgggacgcggcacctacggtcacgtctacaaggcgaggcggaaagatggaaaagatgaaaaggaatatgcattgaagcaaattgaaggcacaggaatatccatgtcggcttgtagagagattgcacttttgcgagaattgaagcaccctaatgtgattgcattgcagaaggtgttcctttctcacagtgacaggaaggtatggctgctgtttgattatgcagagcatgacttgtggcatattattaagtttcaccgtgcatcaaaagcaaataaaaagcccatgcagttgccaagatctatggttaaatccttactttaccagattcttgatggtatccattacctccatgcaaattgggtgcttcacagagacttgaaaccagcaaatatcctagtaatgggagaaggtcctgagagggggagagtcaaaatagctgacatgggttttgccagattattcaattctcctctaaagccactagcagatttggatccagtagttgtgacattttggtatcgggctccagaacttttgcttggtgcaaggcattatacaaaggccattgatatatgggcaataggttgtatatttgctgaattgttgacttcggaacctatttttcactgtcgtcaggaagatataaaaacaagcaatccctttcatcatgatcaactggatcggatatttagtgtcatggggtttcctgcagataaagactgggaagatattagaaagatgccagaatatcccacacttcaaaaagactttagaagaacaacgtatgccaacagtagcctcataaagtacatggagaaacacaaggtcaagcctgacagcaaagtgttcctcttgcttcagaaactcctgaccatggatccaaccaagagaattacctcggagcaagctctgcaggatccctattttcaggaggaccctttgccaacattagatgtatttgccggctgccagattccataccccaaacgagaattccttaatgaagatgatcctgaagaaaaaggtgacaagaatcagcaacagcagcagaaccagcatcagcagcccacagcccctccacagcaggcagcagcccctccacaggcgcccccaccacagcagaacagcacccagaccaacgggaccgcaggtggggctggggccggggtcgggggcaccggagcagggttgcagcacagccaggactccagcctgaaccaggtgcctccaaacaagaagccacggctagggccttcaggcgcaaactcaggtggacctgtgatgccctcggattatcagcactccagttctcgcctgaattaccaaagcagcgttcagggatcctctcagtcccagagcacacttggctactcttcctcgtctcagcagagctcacagtaccacccatctcaccaggcccaccggtactgaccagctcccgttgggccaggccagcccagcccagagcacaggctccagcaatatgtctgcattgaaaagaaccaaaaaatgcaaactatgatgccatttaaaactcatacacatgggaggaaaaccttatatactgagcattgtgcaggactgatagctcttctttattgacttaaagaagattcttgtgaagtttccccagcaccccttccctgcatgtgttccattgtgacttctctgataaagcgtctgatctaatcccagcacttctgtaaccttcagcatttctttgaaggatttcctggtgcacctttctcatgctgtagcaatcactatggtttatcttttcaaagctcttttaataggattttaatgttttagaaacaggattccagtggtgtatagttttatacttcatgaactgatttagcaacacaggtaaaaatgcaccttttaaagcactacgttttcacagacaataactgttctgctcatggaagtcttaaacagaaactgttactgtcccaaagtactttactattacgttcgtatttatctagtttcagggaaggtctaataaaaagacaagcggtgggacagagggaacctacaaccaaaaactgcctagatctttgcagttatgtgctttatgccacgaagaactgaagtatgtggtaatttttatagaatcattcatatggaactgagttcccagcatcatcttattctgaatagcattcagtaattaagaattacaattttaaccttcatgtagctaagtctaccttaaaaagggtttcaagagctttgtacagtctcgatggcccacaccaaaacgctgaagagagtaacaactgcactaggatttctgtaaggagtaattttgatcaaaagacgtgttacttccctttgaaggaaaagtttttagtgtgtattgtacataaagtcggcttctctaaagaaccattggtttcttcacatctgggtctgcgtgagtaactttcttgcataatcaaggttactcaagtagaagcctgaaaattaatctgcttttaaaataaagagcagtgttctccattcgtatttgtattagatatagagtgactatttttaaagcaggttaaaaatttaggttttattcatgtttaaagtatgtattatgtatgcataattttgctgttgttactgaaacttaattctatcaagaatctttttcattgcactgaatgatttcttttgcccctaggagaaaacttaataattgtgcctaaaaactatgggcggatagtataagactatactagacaaagtgaatatttgcatttccattatctatgaattagtggctgagttctttcttagctgctttaaggagcccctcactccccagagtcaaaaggaaatgtaaaaacttagagctcccattgtaatgtaaggggcaagaaatttgtgttcttctgaatgctactagcagcaccagccttgttttaaatgttttcttgagctagaagaaatagctgattattgtatatgcaaattacatgcatttttaaaaactaaaaaaaaaaaaaaaaaaaaaaaaaaaaaaaaaaaaagaaaaaaaaaaaaaaaa

SEQ ID NO: 491 - DNA, 3196 bp, Homo sapiens; identical to SEQ ID NO: 490

SEQ ID NO: 492 - DNA, 3414 bp, Homo sapiens
gcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatcgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcaggatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtggatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatagttgagtccttagaaaatgattccagttactcattttgcatattgctatttaacattattggaccctgcatttatagtcctttgatttcttccctctccctggtgtctcccccaagaccccaaataaagcaataccctgttaacactgtgggtttatatactaattctataccccagatggggaattaggggggagatggtccctgggcttaatattctttaaagggcatgggaatttagcctctcttttattgtaatgtgctcttttggaaaatagttggttagcagggagaccagagttgtagattgagattgggtgtactggctgttctgtggaaaacatacattctgtgttcctcgaataagtgaaattgagcttctaatgagatgcacccctttactaacttgatgatgatataaaattcatttttatttagttaattaccagagagatttagcataattttgcttctggattcagtaaatcaagtcagcttggatcattcaccttaacttttcctttagcagccctttccactagtttcccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccgatcggcattcataggatgaaatgaatgactgtcccagaatgagaatttgtccagattattcagataaacatcataaagagaataacattataaataagtagaatatgaataaatagaataataaaattccaaaatactcaatgggaaatgactagtaatataggctttcaagagttggtacctttacgtatatttgcagattctctgggattttaaggaactgagaaaacagaaaagttgactaaattttatatttcttgtcctctaaatattttgataatttctggattgatgcagtgatgtttttcgttccttgtatttataaatgaaaacctttttttggtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggaccttgttgctaaacaatatcccaatagatttgttgacttgaggtctggtttggttttgtttttgttttgttttggttttgttttgtttcccaatagaattaagaattctaatgttgaaaaactgtataaatttttatgggacaaagcctagaaaagagaaatgtagtttgaatcataatctaaatcatcgtatgataggaaggaaaagttttggtgccataatttctcctttcactggtgttggacttaaatcagttgaaatgtatttctgtaccacaatttacgcttcaataaaagtttaattgtctagtgag

SEQ ID NO: 493 - DNA, 10919 bp, Homo sapiens
gcacgagactgcgctcgcctccctcctcacgcgggcgggattttcttgccttgtgaaaaaccgtctcggcggctgcccccgcctcctctgctggcatgtgaaatggcggtcggcgagtggtttgcgtccgtgacatcatcatcatggcaacaagagctgcagcctgggaccgaggagcccgtgtgattcccggcggtggcgcagtggcggcagcaccagcaccgacgaaagcttcgagggcttctctccttgcggccccttgccgggtgctcctgaggaggcggcggcagcagcgcctacaccgccccgcccgccgttcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactaatacatggccagcccgctgcaggggctggatacctgccaatcccccctcacccaggcccctgtcaagaaggtgccggtggtgcgagtcttcggagcgaccccggcagaataaaacccaagacaagccacataaaagcaacctaaaaattaaactgtcatcatattatttgttttaaaactatggaataatatatctgaggaagatttctctcaaaattgtttttctcaatttcaagtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacacagtacatgtgaattacaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacttgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatgtaagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatataacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcattatcagaagcaatttcacaaaccaaagcactttctcagtgtaaaaatcgaaatgtgtcaacaccttcagcatttggtgaaggacagtctggactggcagttctaaaagaattgttacaaaaaagacagcaggaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggtttgataacaagacagatctatacagatggaaaatggttgatcattatgttagccgtgtccgtggaaatctccaaatgttagaacagctggacctgattgggaaaaccagtgagatggctagactttttggcattcagtttttacatgtactgacaaggggttcacagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtatgatgagttcaaatttggctgtacctctctgagagtacctccagatttactttaccaagttaggcatgatatcacagtgtcccccaatggagtagcttttgtcaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagtaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattattttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaa

SEQ ID NO: 494 - DNA, 1985 bp, Homo sapiens
cgccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatggcgtacagtcaaggaggcggcaaaaaaaaagtctgctactactacgacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcatatatttaatgttggagaagattgtccagcgtttgatggactctttgagttttgtcagctctcaactggcggttcagttgctggagctgtgaagttaaaccgacaacagactgatatggctgttaattgggctggaggattacatcatgctaagaaatacgaagcatcaggattctgttacgttaatgatattgtgcttgccatccttgaattactaaagtatcatcagagagtcttatatattgatatagatattcatcatggtgatggtgttgaagaagctttttatacaacagatcgtgtaatgacggtatcattccataaatatggggaatactttcctggcacaggagacttgagggatattggtgctggaaaaggcaaatactatgctgtcaattttccaatgtgtgatggtatagatgatgagtcatatgggcagatatttaagcctattatctcaaaggtgatggagatgtatcaacctagtgctgtggtattacagtgtggtgcagactcattatctggtgatagactgggttgtttcaatctaacagtcaaaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatgagttgccatataatgattactttgagtattttggaccagacttcaaactgcatattagtccttcaaacatgacaaaccagaacactccagaatatatggaaaagataaaacagcgtttgtttgaaaatttgcgcatgttacctcatgcacctggtgtccagatgcaagctattccagaagatgctgttcatgaagacagtggagatgaagatggagaagatccagacaagagaatttctattcgagcatcagacaagcggatagcttgtgatgaagaattctcagattctgaggatgaaggagaaggaggtcgaagaaatgtggctgatcataagaaaggagcaaagaaagctagaattgaagaagataagaaagaaacagaggacaaaaaaacagacgttaaggaagaagataaatccaaggacaacagtggtgaaaaaacagataccaaaggaaccaaatcagaacagctcagcaacccctgaatttgacagtctcaccaatttcagaaaatcattaaaaagaaaatattgaaaggaaaatgttttctttttgaagacttctggcttcattttatactactttggcatggactgtatttattttcaaatgggactttttcgtttttgtttttctgggcaagttttattgtgagattttctaattatgaagcaaaatttcttttctccaccatgctttatgtgatagtatttaaaattgatgtgagttattatgtcaaaaaaactgatctattaaagaagtaattggcctttctgagctgaaaaaaaaaaaaaaaaag

SEQ ID NO: 495 - DNA, 3206 bp, Homo sapiens
agtgagactgtagggtgggcggtgcgagcggcggttagctcccagttcggcctctgaggaaaacgggcgttcgcctgcggttggtccgactgttagcaacatgagcggcctggatggggtcaagaggaccactcccctccaaacccacagcatcattatttctgaccaagtcccgagcgaccaggacgcacaccagtacctgaggctccgcgaccaaagcgaggcgacacaggtgatggcggagccgggtgagggaggctcggagaccgtcgcgctcccgcctccaccgccttcagaggaggggggcgtaccccaggatgccgcgggccgtggcggtactccccagatccgagttgttgggggtcgcggtcatgtggcgatcaaagccgggcaggaagagggccagcctcccgccgaaggcctggcagccgcttctgtggtgatggcagccgaccgcagcctgaaaaagggcgttcagggtggagagaaggccctagaaatctgtggcgcccagagatccgcgtctgagctgacggcgggggcggaggctgaggcggaggaggtgaagacaggaaagtgcgccaccgtctcagcagccgtggctgagagggagagcgctgaggtggtgaaggaaggcctggcggagaaggaggtaatggaggagcagatggaggtagaggagcagccgccagaaggtgaagaaatagaagtggcggaggaggatagattggaggaggaggcgagggaggaagaagggccctggcctttgcatgaggctctccgcatggaccctctggaggccatccagctggaactggacactgtgaatgctcaggccgacagggccttccaacagctggagcacaagtttgggcggatgcgtcgacactacctggagcggaggaactacatcattcagaatatcccgggcttctggatgactgcttttcgaaaccacccccagttgtccgccatgattaggggccaagatgcagagatgttaaggtacataaccaatttagaggtgaaggaactcagacaccctagaaccggttgcaagttcaagttcttctttagaagaaacccctacttcagaaacaagctgattgtcaaggaatatgaggtaagatcctccggccgagtggtgtctctttctactccaattatatggcgcagggggcatgaaccccagtccttcattcgcagaaaccaagacctcatctgcagcttcttcacttggttttcagaccacagccttccagagtccgacaaaattgctgagattattaaagaggatctgtggccaaatccactgcaatactacctgttgcgtgaaggagtccgtagagcccgacgtcgcccgctaagggagcctgtagagatccccaggccctttgggttccagtctggttaacatttgcccttgggaatactcctgcacaaggtctcctaccaccttctgctggacctgtgcttgggcatcagcaatgagtatgccttctattgtgctttgtttttgctgacttttctgcaccctgtttcctttggatattcagttctctcaacctcaagattgagacggtggtgggtatgcttctccacttccatatgaccttcatgctgttctggaatatcacatgctacgaggtcatccttcacactacttgtaagccaagcaaatgatactgtagattgtactgcctttatctgcactgcttggaccctgtttattcccagggcctctgaactggttgctgtcacttggatttctagctttgggagcctgttccacctactcagctctgcattgagcagtatgggcacatgccctgtggacagttactggacgttaatgaactcagaggagaaaagcagtgagccacttgttctgtgtgatttatggtacttcattgctcttccttcacctctagtcactttctattgctacctgccctacattggctcctgccaaggtccctctctctccctgttttccttttttttttttttttttttttttttgagacggaggacggagtcttgctctgtcgcccaggttggagtgcagtggcgcgatctcggctcactgcaacctccacctcccgggttcaagcgattctcctgcctcagcctcccgagtagctgggactacaggcgcgcgccgccacgcccggctaatttttatatttttagtagagacggggtttcaccatgctggccaggctggtctcgaaccccgatctcgtgatccgccctccttagcctcccaatcctctcttaaaaaagtgatagctcagaaacatttgtaaaagcaaggtttttatttcattttggctctgtcattttcagaggcaaagaagttggcctgtaaaatagagtgctagagctcttacgcccctccccttcttcccaacttcctacttcctagcccttttatcaactcctagaatagttaaagagagacacatctagatgggatgaaaggtgccctaagcaggagaaactgaacaaaaggctagaggcatgggccaggtaaaaattgggcctagagtgaagactgtgctgtcgttaagagctttcgaggaaggagtacttactccccaatgatgatgaatggaaaaatacttttcagggagaattgaaggggttaaagtgttaaatatgttgcctagacaagggttctttaaagaaagacagcgcaactttgaatgctttcttacttgttttgtgacctaatttatgtggaagattgttatttcattaggatttagtaaaatttttttttctgattctaaacttattgtgaaaattgagctgtacagatattcttttgatttcaattgggaacatttggaagaacaacagtcttacttgcctgtacaatatagagacatatgaatagtcataacagttttcaacttgttcttgtttctgttaaactatattcctagaaacatagtttgaacaacttggtctttgttaggcttgtcaaattgccttcatggaaaaataatctacaaaagtatggtttaattgattgtcttacatgataattttccctggtaacaacttagtaagtgatatatcttttttcctaaattgcttaaatactgtgaaattgctctgacaaattggaagtgtaccattggcatatttgtcttcctttttatgcatgatggtaaaataaaagcatgttgttctgctag

SEQ ID NO: 496 - DNA, 2367 bp, Homo sapiens
aataggaaagctgcaaaacactgtggagtgctcccgtgtaaataaaaagaggaaaaaagtttctcaagtcgccgctgcacgacgtctggccggcgctggagcgggggtctgcgctctcccgagcggccgcgcgctggactttattgtgccgcaaccagccccagttcccattgtttgtgtttttttcaaaatatggcaaaggttcaggtgaacaatgtagtggtgctggataacccttctcctttctacaacccgttccagttcgagatcaccttcgagtgcatcgaggacctgtctgaagacttggaatggaaaattatctatgtgggctctgcagaaagtgaagaatacgatcaagttttagactctgttttagtgggtcctgttcccgcaggaaggcatatgtttgtatttcaggctgatgcacctaatccaggactcattccagatgcagatgcagtaggcgtaactgttgtgctaattacttgtacctatcgaggacaagaatttattagagttggctattatgtaaataatgaatatactgagacagaattaagggaaaatccaccagtaaaaccagacttttctaagcttcaaaggaatattttggcatctaatcccagggtcacaagattccacattaattgggaagataacacagaaaaactggaagatgcagagagcagtaatccaaatctacagtcacttctttcaacagatgcattaccttcagcatcaaagggatggtccacatcagaaaactcactaaatgtcatgttagaatcccacatggactgcatgtgaccacctaccatccctttagtacaaattaagctattaaaaatacacagaactatttccctgaattccgtaagtacatagtcaaaacacaatgtgaagaatttgtttaaaaacatcctgtagaaagtttataagaaaaccagtatttgaacaaattgtggaatataaatacaactatttttaagtaatttttttctctaatgtgttattttatttgttctgaaactaatctgattaaagcatatatattattttcttctcctttatatgtaatgaaagcacttataaagaaacaggaatcattagaccaggttgtaaagatgtcttggcctcccagacagtctttggaccactattttactggcctttgaaagaacaaagtttacttcaactaaaatgtttcttcctgtgaagacatatggtatcattttaatttaaggggcagatttccattcttttttggcatgtccttaaaaagaggatttgaaatcaactatatgctaccaagaactttaggatccaattttccaagccaccgtgaagcctcttatggctactattatagttcatgagatgttggacagcatttggtttgtttggtaagagaagaacaaatatggctaattgttaataaggtcccctggctatggtttttgttcttataacagagtttagaatatcagagcatttcttgaatcatacatcattattgtccagtgaattcaagaccgaatacaatatcgggagaaaatacaaactccctgtgtttaagaataggggattataatggctcaaattggttcatttgatttctaaaaataccatgacctttaaaaattcttttaatagatcatgttattggcagtatttatataaaaaccatggatttagaaaggtatatttagctttattataatagatacgttactattttggaaatatatatattttcacacctgtagtactcttccccatttcctctgacactcatgcagaatgagatcaggcatatttgtggttgacatactctagatagcttttccaacaaatctttgaaaagcaatcttggaaaggaattcattaactaaatggggtaaaaggtttctttttctttgagagttaagtccttcctcaaaaaattttcttatgctccataaaattgaggtagaatactttcattattcttgcagctaagcaagacagccatatgatgcaggttatgcagtgccttcatatctaaaacttttatactgcactttttaaagcttttatgttgaggaaaggaaaagggcatttgtctaaacatggattctgagttgtatatatttcctatcattctaaaaaagtgaatttgtgaagcaaagttttgccagatgttaaactttgaatttaatataccagattattaaaatattgtccattaactagttcatagattttaaaagtaaaatacttctgactgttaaaactatataaagaaaatctcatttgtctaattgcaattaaaagaaaaatgttaaaatattaaaatgaaaataaaagcattactttccaaaaaaaaaa

SEQ ID NO: 497 - DNA, 7163 bp, Homo sapiens
tgaccctgaggcattgccgtcgcgcggtgcacagctaagacgtcgcgcttgcgcaggcgctcggcgcagaggcctgcgggaagccaagatggcgcataggggttctccaggctgcagttggcgccttatcagtatctaagcggagtgttttggaaggagttaaggggctgtggcaaacgccctctccgccgtcatggcccggcatcggaatgttcgaggctataactacgatgaagattttgaagatgatgatctctacggccagtctgtagaggatgattattgtatttcgccgtcaacagctgctcagtttatttattcacggcgtgacaaaccttccgttgagcctgtggaagaatatgattatgaagatctgaaagaatcttccaattctgtttcaaaccatcagctcagtggatttgatcaagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggaaaaccagtagattcccagacatcgcgaagtgaatctgaaattgtgccaaaagttgctaaaatgactgtatctggaaagaagcaaactatgggatttgaagtgcctggagtatcttctgaagaaaatggtcatagtttccacacacctcaaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggggagtaaccatggatgttggtatgacaaagtttgaaaccacaaccaaagttattacattaatggatgctccaggccataaggacttcattccaaatatgattacaggagcagcccaggcggatgtagctgttttagttgtagatgccagcaggggagagtttgaagctggatttgagactggaggacaaacacgagagcatggactcttggtccgttctctgggagtgacgcagcttgcagttgcagttaataaaatggatcaggttaattggcaacaagaaaggtttcaagagattactggaaaacttgggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgctaagatttatggcaagtgtcaaaaatagtatctgaagatactgaatcatcatgaaatgaactctacttctggccaaagcacaatgtatttgcagttttctcttttgattcaattatactgcacatgttttaaggaaaagtaacttaattgggtttttcaggcagttgatatttgacctaagcttttttttttttttttttttccagttaatgctaagaaaagatttggggaaggttataataaaagtattttgtggtgaccataagaatgtccctccccaaaacaagtaaacttgtgaaagtttaatttggaattagtggaagctgttcctttgaaagccaagatattatttaagttgtaaagccagctaataaaatgccttagtttgagcataatacaaactgtgttttgttctttagacatttatgagattctctgccactaacagtaaatatgatttaggggttttgtgggatctttttcacctaagagtttcctagctctgtcacatgaattcttttttatcctaatggcagatccaatttcatctcattcatttttttaaccataacttgcttttcccattctcacttttagaattatacctatgatggccctttctttatcttgcttaccttatagattataagtcccctgtgagtaagtaagagtcatgtttttctttaaagtttcaacaacaaaccccaaggtttatttatttaacaacaggtattcgttgaggtgccttctgggtgcaaggagctttagagtagattttgacctcagctgaacctggaactctgatctgatagactgtttatgataagcttttttttttattagcagcgtgatttgtatatcgatggcttaacatatacaacagcatttcttctccctgcaccttttcgtgaacctgacattttgaacataagcaataacatctgtatggtaaagtaggcagattatacatgtgttgcttagtgaatgattaccaagtgaacacacttggtatattgctttaccaaaatacatgtgtagttgtcacttcagattcactgagttaagaaagttttatttaaatattaatattaatcaagaatttaacagatatatgtgacagaaatctaacttcaagtgactgaagcagaaagaaaaatttttgaatgacataactgagaaaattagaggtagctctagctttgattccatttagatcgagcagctcacacaatgttagcaaggactcatctccactctgccttccctggtgctggttttgctctcaaactctatatagaactctcggccgggcgcggtggctcacacctgtaatcaaaacactttgggaggctgagtcgggaggatagcgtgagcccaggagtttgagaccagctaaggcaatatagtgagaccatgtctctacagaaaaaatttaaaaacagatcagctgggtgtggtgccacatgcctgtagtcccagcttctcaggaggctggggtgggaagatcacttgagcccaggaggtcgaggctgcagtgagccatgatcacatcactgcagtccagcctgggtgacagagcaagacctgtcaccctgccacccataaaaaacctcttctgtaatgccaggttcttgacaagatgtgataattccacacttacatcctcagatctcccatccagggcaaggacagactaaaagagcatatcttctccagaagtcctagaaacatctcatcattgactatgattgaattttatttattaatacttccctaggatatcctgtgtttgagtgtgaagttaatatcacacaaagcatgtagctaacagttgtgtgagggttggaaattcagggtgctgttaggaaggggaaatggattggggtttaaggtagggggagtaaaaacaagaaaccatccactctgtatattatataagactgtgatcgaattaagaattttagtttacagtttagcataaacaaatagtagtagaaatgaatgcatttattcattccttccttctccaatagtgtttaagtacaatctttttatttgcattttattgatgattgattgtggttgaaaggagtggtgatattatttcgaggatccactgtgtaagaagactgttggcagtggaaggctcgagttgattaagtgacaaagaggtaaagcagacatgcccaagcttggttatgctctgatttcctaccctgttactttcatccataatttatagtacatccattttgtgtcattttgcttcaggtatttcttgtcctgactgtcttcttttttatgattttactgtttcttcacactaatggctttgtcctctgactttgactctttgtgagattcttctgagcagttaacctctaggataatgtggcttgaacacattacagaactatgttttgacttgttagtattattcacacattcatgacaattgagcctctctactgtgagaaatgttttagaggccagtttctaggcatagctgtttttctcccatgagtatgcaaatcaatagttttaaccattgttaaaatgcaatcatagtgacttcagaaaatttggaaaatacagaaaatatagggaagaataaaattaacccacagttctgtcacctaaaggtaactgctgccaatgttttcatgtatttcttttctgtctctccaatgcatttttttacatagttgtgagcgttagccaagttattttcatgttgttatgtaatcaatatttttcaatagaagtattagaggttttttttattgatataaaaataacaattacagatcctgatatatagaagttattcaaaattatacagttttcaaaaaatcaagacaagtaggcccaatacaaactactgaatcatcttctaatttccctctaaaatatttatagaaatatgtaagtagaaaaacattcatcctttcctcgtctaattatgatcctgccatattccaggcacaagagaaagctctggggcttgagtcttaatagggctgatagtccaaccaggggacagggtatcataaagagataattcaaaactttaagattggagggtaggtgatggtagaaaattctgcggcaaacatttgttgatgctcatcatttgttgatgtcatcaaagatcaccagggcataattataatcaaaattagttttattgatgcttgctgcagcaagagagactgcacaccactggggtctatgggtgcttctcagtgggaaggtgtaaggaggggcttgctaagaatttgagcacatgtagctaattttaaggagggctcaagtgagcaagggtttcttctggattgagtgctgtcagaaagtggattgagtgctgtcagaaagtgggagtgattttgcaactgggtatcttaatttttatgttgtgggtgggaggaaaggaaagaagcaacagtcacccatgttagccacaagaagaggttggctgtttatggtttgcacagtgactttgtttttatctgtgctcaggcatgattacagtatctcattttatccggattacagtgacctcatctgatgttagagatttgagaattgttaaatgttcagcaggagaacgccaccgcctagtgtgaatgctaggtcagaagctgctttttcacactgaaaccatttaagtatgtacaaataagttaatagtgtaaatgtaggtgtaaaatacaatgcaaaacaaaataatgaagtaagtgaattaaattattgcaccaaatatggggatatgaaatagggaaagaaaagcattaagttacttatagtccataaagggactacattattttgttactctgataatcccataaaacaaagttttaagaatgtttacagtaaccatgaatggaattagtgaaactattcatatcaatgcaaaaaaaaaaaaaaaaaaaagcaaagaaactaagtctgtacagcaaaagatggtaaggaaacaagaaaattaaatgaagacaaaggttgtgattattacagtaaatgaaaataggtttttatctttaaaatgtagactcaaactgcaaagctaatgatatgctatctgcaaaatattcctattttgtaaataaataaaaccatagatttaaagaagaaagggcacagatgtactggggagacaaaaataactgatccgttgggtgtataccatgtgccaagcaattttcatatactcatttaacatgacatatctataattatatgaggcagatattattaacctcagtctatagatgagaagactaaagctcagagggattgctaaaaactagtaaataaattatggaaccatgatttgaatttagatttaagtctgactgaggcatgttcaaagacactacactgcctctccagaaatcaggagtagcaatattaacactggacaaagaatttaaagcaagtaaaaaaaaattaagagaatttcatattaataacaagtataatgcacaataaaactgtaccaaatgacataaaaatgcataatgaaatttattagaaattaaaaattaaagggcatagttacaattattgaggaattctcatagctctgccttatagatcatgtaaacaaacaaggtcatagaggacttaaatagcaaagcagaaaaaaaaaaaaaaaaaa

SEQ ID NO: 498 - DNA, 5538 bp, Homo sapiens
gcggcacagagccgcggcttgctttcaggacacgggtcgctggcgggttaggtggctgcgtggccgcctcacttcgcgcacgcgccgctaggctgggggagttgatttgcactgctccgggtgtcggctccggcgggacgggcggttctgcgtacccctctccagtgtcaacctggggctgaatcttcaacctgtcaaagccttcttaattatgtctgagaaaaggatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacggtagtggctctttatgactacacagcgaatcgatcagatgaactaaccatccatcgcggagacattatccgagtgtttttcaaagataatgaagactggtggtatggcagcataggaaagggacaggaaggttattttccagctaatcatgtggctagtgaaacactgtatcaagaactgcctcctgagataaaggagcgatcccctcctttaagccctgaggaaaaaactaaaatagaaaaatctccagctcctcaaaagcaatcaatcaataagaacaagtcccaggacttcagactaggctcagaatctatgacacattctgaaatgagaaaagaacagagccatgaggaccaaggacacataatggatacacggatgaggaagaacaagcaagcaggcagaaaagtcactctaatagagtaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctgtttttgaaattcactttatttaaaagataagcagctgactgggcacggtgcctcatgcctgtaatcctagcaccttgggaggctgaggcaggtggatcacctaaggtcaggagttcaacaacaccagcctgaccaacatggtgaaaccccatctctactaaaaatacaaaaatcagccgggtctcatggcaggcacctgtaatcccatctactgaggcaggagaattgcttgacccaggaggcagaggttgcagtgagccaagatcacgccattgcactccagcctgggggacagagcaagactctatctccaaaaaacaaaaaagataagcagctttagaatatggcgcattcaaaacagtctcagtaacaaagacattaaaagaaaacaatttactttctaattaaaattttgtgtttcttaagatcaaatcatataggtaacttcatagacctaaattaaaagtgatttttggctggactggcaacaatgttcccaatgtctttactttttaaaaaaggcttttcatatttaagcacatacctattttgtagacttacattgtttaatatttattttaatcttaatatttttacattattatattgcattatttattttttctaagttccagaataatagtgtcattattatagactatatgttttgaagtttgatattataatgggatattcattttttgttcttttcttgactcctttctcaagtgtgtgataaggtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataactggtgaagcctacagccatccgcccaaaagtctgttctgatggcactgagttttcattgttctggatgtataagtctgtgtgtcaggtacagctgggcccagccagcttgagtcactcttgtacaagcttgtttttttctgtcttgtgaatgcacttgataatttaaaaataaaaatatctgtttctctgcaaaaaaaaaa

SEQ ID NO: 499 - DNA, 5215 bp, Homo sapiens
cgagcgcggcgcccttgagctgcaccgcggcgcaggtttgcgagccgacttgtcagccggccaagaaaaggaagctccgtcccttcccgctcacccggcttccccaccccttgtactctaaactctgcagagggcgagcggcgcggccacggaggcgccgaggaggagcgagccgccgccgggcagcggcgtgccctcgggggagagggcgccggagaggaggcggcggcgcggcggcgagggcgcggcgcgcgatggcagctgcttagcccggcgggcgcggagcagccccgagctgtggctggccaggcggtgcggctgggcgggggacgccgccgccgttgctgcccggcccggagagatgagcacggaggcggacgagggcatcactttctctgtgccacccttcgccccctcgggcttctgcaccatccccgagggcggcatctgcaggaggggaggagcggcggcggtgggcgagggcgaggagcaccagctgccaccgccgccgccgggcagcttctggaacgtggagagcgccgctgcccctggcatcggttgtccggcggccacctcctcgagcagtgccacccgaggccggggcagctctgttggcgggggcagccgacggaccacggtggcatatgtgatcaacgaagcgagccaagggcaactggtggtggccgagagcgaggccctgcagagcttgcgggaggcgtgcgagacagtgggcgccaccctggaaaccctgcattttgggaaactcgactttggagaaaccaccgtgctggaccgcttttacaatgcagatattgcggtggtggagatgagcgatgccttccggcagccgtccttgttttaccaccttggggtgagagaaagtttcagcatggccaacaacatcatcctctactgtgatactaactcggactctctgcagtcactgaaggaaataatttgccagaagaatactatgtgcactgggaactacacctttgttccttacatgataactccacataacaaagtctactgctgtgacagcagcttcatgaaggggttgacagagctcatgcaaccgaacttcgagctgcttcttggacccatctgcttacctcttgtggatcgttttattcaacttttgaaggtggcacaagcaagttctagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggactatgattctattgtgaagctggtagagactttagaaaaactgccaacctttgatttggcctcccatcaccatgtgaagtttcattatgcatttgcactgaataggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttggttcaaaaaggcatttgaatctgagccaacactacagtcaggaattaattatgcggtcctcctcctggcagctggacaccagtttgaatcttcctttgagctccggaaagttggggtgaagctaagtagtcttcttggtaaaaagggaaacttggaaaaactccagagctactgggaagttggattttttctgggggccagcgtcctagccaatgaccacatgagagtcattcaagcatctgaaaagctttttaaactgaagacaccagcatggtacctcaagtctattgtagagacaattttaatatataagcattttgtgaaactgaccacagaacagcctgtggccaagcaagaacttgtggacttttggatggatttcctggtcgaggccacaaagacagatgttactgtggttaggtttccagtattaatattagaaccaaccaaaatctatcaaccttcttatttgtctatcaacaatgaagttgaggaaaagacaatctctatttggcacgtgcttcctgatgacaagaaaggtatacatgagtggaattttagtgcctcttctgtcaggggagtgagtatttctaaatttgaagaaagatgctgctttctttatgtgcttcacaattctgatgatttccaaatctatttctgtacagaacttcattgtaaaaagttttttgagatggtgaacaccattaccgaagagaaggggagaagcacagaggaaggagactgtgaaagtgacttgctggagtatgactatgaatatgatgaaaatggtgacagagtcgttttaggaaaaggcacttatgggatagtctacgcaggtcgggacttgagcaaccaagtcagaattgctattaaggaaatcccagagagagacagcagatactctcagcccctgcatgaagaaatagcattgcataaacacctgaagcacaaaaatattgtccagtatctgggctctttcagtgagaatggtttcattaaaatcttcatggagcaggtccctggaggaagtctttctgctctccttcgttccaaatggggtccattaaaagacaatgagcaaacaattggcttttatacaaagcaaatactggaaggattaaaatatctccatgacaatcagatagttcaccgggacataaagggtgacaatgtgttgattaatacctacagtggtgttctcaagatctctgacttcggaacatcaaagaggcttgctggcataaacccctgtactgaaacttttactggtaccctccagtatatggcaccagaaataatagataaaggaccaagaggctacggaaaagcagcagacatctggtctctgggctgtacaatcattgaaatggccacaggaaaacccccattttatgaactgggagaaccacaagcagctatgttcaaggtgggaatgtttaaagtccaccctgagatcccagagtccatgtctgcagaggccaaggcattcatactgaaatgttttgaaccagatcctgacaagagagcctgtgctaacgacttgcttgttgatgagtttttaaaagtttcaagcaaaaagaaaaagacacaacctaagctttcagctctttcagctggatcaaatgaatatctcaggagtatatccttgccggtacctgtgctggtggaggacaccagcagcagcagtgagtacggctcagtttcacccgacacggagttgaaagtggaccccttctctttcaaaacaagagccaagtcctgcggagaaagagatgtcaagggaattcggacactctttttgggcattccagatgagaattttgaagatcacagtgctcctccttcccctgaagaaaaagattctggattcttcatgctgaggaaggacagtgagaggcgagctacccttcacaggatcctgacggaagaccaagacaaaattgtgagaaacctaatggaatctttagctcagggggctgaagaaccgaaactaaaatgggaacacatcacaaccctcattgcaagcctcagagaatttgtgagatccactgaccgaaaaatcatagccaccacactgtcaaagctgaaactggagctggacttcgacagccatggcattagccaagtccaggtggtactctttggttttcaagatgctgtcaataaagttcttcggaatcataacatcaagccgcactggatgtttgccttagacagtatcattcggaaggcggtacagacagccattaccatcctggttccagaactaaggccacatttcagccttgcatctgagagtgatactgctgatcaagaagacttggatgtagaagatgaccatgaggaacagccttcaaatcaaactgtccgaagacctcaggctgtcattgaagatgctgtggctacctcaggcgtgagcacgctcagttctactgtgtctcatgattcccagagtgctcaccggtcactgaatgtacagcttggaaggatgaaaatagaaaccaatagattactggaagaattggttcggaaagagaaagaattacaagcactccttcatcgagctattgaagaaaaagaccaagaaattaaacacctgaagcttaagtcccaacccatagaaattcctgaattgcctgtatttcatctaaattcttctggcacaaatactgaagattctgaacttaccgactggctgagagtgaatggagctgatgaagacactataagccggtttttggctgaagattatacactattggatgttctctactatgttacacgtgatgacttaaaatgcttgagactaaggggagggatgctgtgcacactgtggaaggctatcattgactttcgaaacaaacagacttgactgttgctcaatctaatcttcgatggaaattctaaaaattaatacagagctgatcttcttgggggtgggaaaatcgaagggagaggagaaaggcgctgcactttaaatccagtatttgtttactcatgttaaaaaaaaaaaaaacagacaaaacacactgaaatttcctaactacatctatttctataatttttaaggactcttcataaggactcttaaaataatcctgaacattagaaccctaatgttcaggaagattttaatctaagcatttttatggaaatatttttaatgcagcagctattgcacttcagccaaatgtttatttcacacaaaacggatgtaacatttcatgtgatcgtgcaccactggaacaaaaccaaaatgtgaccataactgtttaggcttctgtgtgtttgtaatatgctctaataatctgagtagaaatgcgtaatttcaattactgtataaagtttatgtttttttaagtgtgcagaatctgagagcaatggtttttacttctctgtgttaattgtaatattgactctattttgtaacttaagtttctgacctgtcgtacatttgtttgagtcgtttatgtactactgaactgtaccagttgcacatgcttgaactgtagtaatgttagcttgttctaaagctatccattgtgtcatatttactctaaaaattaaagagactctcaacaaaaaaaaaaaaaaaaaaaaa

SEQ ID NO: 500 - DNA, 3682 bp, Homo sapiens
gaccatcagaccggcctgaataccagaatctctttgcaatgcactcgcctcgctcattaccagaaggaggttttacctgcctagtgacctggttggtctgggcatgaaccccgagaggtggaaactctcagactctcaggactgacagccgagtggctggggactataaatccgcgagaactgccctcgcgctgccatccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatatatgggcaaaagaaatggctgaataaatcagaatgcagaaatatcaatagaacctactgtgatctttctgctgaaacttctgactacgaacaccagtattatgccaaagttaaggccatttggggaacaaagtgttccaaatgggctgaaagtggacggttctatccttttttagaaacacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccgtatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctctcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaattacttatttcttttctctattctcatagcacgtgtgtgattggttcatgcatgtaggtctcttaacaatgatggtgggcctctggagtccaggggctggccggttgttctatgcagagaaagcagtcaataaatgtttgccagactgggtgcagaatttattcaggtgggtgtactctggcctcttggttcattattttcaaacaagcacacttgtacaattattttctgggtacttcccatatgcacatagcactgtaaaaaatatttcccaaagatcactcattttataaataccactttttcagaattgggtttattgcgagcaggaggagatacttaaaacatgcacatataccaggttggtggtaagttggtcgcatgtgaaaacctcaactatttaatcatcatgattcatattttgagtgaatacatcaggcacagaccttcatgatatcacacactcttggctactttaagaggccatctttaatactttatgagtagttctggagtgtaaacataaacgagtattcttttgtagtcagaaaagtgtcctctcaataatttagtaggggcttattgtctctcaaaactaacctaaaagaaaatgacacattttataatagaatattacatttatttctggaagtgtgttttcaaaaagatatttacatagtctgtaaactagaaagtgttaggtaaagctctaggttactgtgttactattataatattaaacattcgaataggcagtcgttcaaagactctttggaatatctatgaatgaatatcctctattcttataatattaaaacccataagtaaatataggacatacaagagaaatgagttaaatgactatgtaagggagagtttattaaaatttgatgaaatttactgtaggaactaaactatgccataaaacaatagctttctagttcatttccagtaactgttcccatctcctttaccacttgttaagaaaattaaattcttcagtcacgctgctttaaaatgggacaaaatctattaagttgaaccatatataattgtggatatttggctgtttttaatctgacaagcagtaacttcatatggtttgccttaatatatatttgttttagtcatgaactcataatccattgatgctctttcatgagaagagatatcacccatatttccttattgatattattggtacaggcagacaaccctggtaggagagatggattctggggtcatgacctttcgtgattatccgcaaatgcaaacagtttcagatctaatggtttaatttagggagtaattatattaatcagagtgttctgttattctcaatctttatagaaacgattctgctggttttgaagaacagatgtattacactaactgtaaaagtagttcaagagtgagaaagaataaattgttattaagagcaaaagaaaaataaagtgattgatgata

SEQ ID NO: 501 - DNA, 1282 bp, Homo sapiens
ggcgggccgaagcgaggtgcggctccctgtcgccgcggaggggcgggggcaggacgcgcaactccggccggagctgtccggggtcgtgagccggccccgccttggtggcggcgccccctcgcggtccagaggcagacgcatcgggtgggctcgggtctccagcccggccgggaggagggaccgggtctgcggagcggggactcggggcctcggcggggcgcgcacacgcaggcggggcggcccggggtgcggggcctctgcgcggctgaccaggctcccagagcgtcagcgccgcccatggccgagccgctccagccagaccccggggcggccgaggacgcggcggcccaagctgtggagacgccgggctggaaggccccggaggacgccggcccccagcccggaagttatgagatccgacactatggaccagccaagtgggtcagcacgtccgtggagtctatggactgggattcagccatccagacgggctttacgaaactgaacagctacattcaaggcaaaaacgagaaagagatgaaaataaagatgacagctccagtgacaagctacgtggagcctggttcaggtccttttagtgagtctaccattaccatttccctgtatattccctctgaacagcaatttgatccacccaggcctttagagtcagatgtcttcattgaagatagagccgaaatgactgtgtttgtacggtctttcgatggattttctagtgcccaaaagaatcaagaacaacttttgacattagcaagcattttaagggaagatggaaaagttttcgatgagaaggtttactacactgcaggctacaacagtcctgtcaaattgcttaatagaaataatgaagtgtggttgattcaaaaaaatgaacccaccaaagaaaacgaatgagaaaaatgaaaggaagttctgctgtcagaggcaaaacatctgtttatcatagacatcaacatgacctataagtaaagtgcgtgtctagtgtcttctattgagagtactactattaattaagcttatttccaatgtgcctttttaatgcttgaagttttatctacatacacaggtaacagaggacagtagtctgtaaacatataaatcggtcataactatcgtggtctttatttctgtgaggatctagggaaatttcatgtcacttccctccttcactgcatcacaatcatattcccttttttttttcttggatttgtgtcagttggatgatatcccctccagatagtatcaataaaatgttaaaatt

SEQ ID NO: 502 - DNA, 1504 bp, Homo sapiens
ggcggagtagcttccggaaagggtactgcatttcccgtttctacctccactgcacccgcttattgcgtcttgctcctgggtcacagagcctaaaacgacacacccaacacgcccgccggagttacagctaaaggaaggacaggggaagcaatgaaatgccgagggcggagccaagagcgacactgggggagcaggaaaaggcggggcttccgcttggggcatggaggctgtacctcttacgtcacttccgtaaacaaacggagctgcggaggagcgggtcccgggatgtgaccggggctctgcttgtggctgcggcggtggcttctgaggctgtcgggtctttgcgggttgcggaagggggccccaatacccttcttcttcaggtcttaagaagctggccgtggtgcaataaggaacttaaaacaatggaagagcggaaagtgaagaggaggagtcctaagtcttttagtgcccactgtactcaggttgtcaatgccaaaaaaaatgccattccagtgagtaaaagcacagggttttcaaatcctgcatcacagtcaacttcacagcgaccaaagttaaaaagagtgatgaaagaaaagaccaaacctcagggtggagagggcaaaggcgctcagtcaactccgatccagcactccttcctcactgatgtctcagatgttcaggagatggagagagggctgctcagtcttttgaatgatttccactctggaaaacttcaagcatttggaaatgaatgttccattgaacagatggaacatgttcggggaatgcaggagaaattagctcgcttgaatttggagctctatggggagttagaggaacttcctgaggataagagaaaaacagccagtgactccaatctggataggcttctgtcagatttagaagaattgaattcttccatacaaaaactccatttggcagatgcacaagatgttccaaatacttctgctagctaaaatgaaatgtagtttgctttcttgtgatttgaagagaagcagcagtctttacttttccagccaaatccagtagcagaatcatcttccacaacaaggaattaaagtaattaaagtgcaagttcaatgatcgttttcacttactgcttttagtaaatgtgactcgctgtaattcaccataactggaggcctaggccttgttgaaggcttcatcaggaaatgtgacgcagagattgtgctgctgtgcttcatattgttgccttatgggattatacttgaaatgcattgtgctgatgttcttgacagggcggagggatttctctttcctgagctcaccaaacttattccagtgttgatcgcaagctgttgatgcacaggcgtcttgtggcaagcccagcttcagtttatgttagacaatcagtacacatgctggtgtgttttccaatggccagtgataagaaattaaataagtatttgtgagatttgctattttttaataaagtaattgttttaaattaaaaaaaaaa

SEQ ID NO: 503 - DNA, 5634 bp, Homo sapiens
gccttttccctccggctcgggagcgtctcgcttgcgccccgggcccgcggcgcccgcgcggctgcgagcctcgggtggccgcgtgccggctccaggaagccggagagggcgcggcggccaggatggcgcggcacgggccgtgcggctagacgggagccgagggaaccgccggctcgcgccctccgttctttcccggagccggcttcacgcagggccgggaacggccgtgcctctgggatccgccttcgctgacgccgggcacctacctggacgcgagcgagcgagatgcccaaccccaaaaacagcaaaggcggccgcaaaaacaagcgcgccaacagcagcggcgacgagcaggaaaatggagccggggccctggcagcggcgggcgcggcgggagcggcggccgggggggccctggcggcggcggccggttgcggggcggcggcggcgggcgcgccgggcgccggaggcgcggcgggcgccggaggcgcggggactggcgccgcgaacgctgcggccgccgcgggggctgcggccgcgggcgatgccaaaaacgaagccccatgtgccactcccctgatctgcagcttcggtaggccggtggacctggagaaggacgactaccagaaggtggtgtgcaacaacgagcactgcccctgcagcacctggatgcacctgcagtgcttctacgagtgggagagcagcatcctcgtccagttcaactgcatcggccgcgcgcgcagctggaacgagaagcaatgccgccagaacatgtggacaaagaagggctacgacctggccttccgcttctgctcttgccgctgtggccagggccacttgaagaaggacacagactggtatcaggtgaagcggatgcaggacgagaaaaagaagaagtctggctccgagaagaacacagggaggcctcctggtgaggcggcggaggaggcaaaaaagtgcaggcccccaaataagccccagaaaggcccaagccacgacctcccccgccggcattccatggaccggcagaactcccaggagaaggcagtgggtgccgcagcctacggtgcccgttcccccggtggctccccgggccagtccccacccacgggctactccatcctctctcctgcccacttcagcggcccccgctcctccagatacctcggggagttcttaaagaacgccatccatctggagcctcacaagaaggccatggctgggggccatgtgttcagaaatgcccactttgattacagccctgcggggttggcagttcacagggggggacacttcgacacccccgtgcagttccttcggcggctggacctctccgaactcctcactcacatccccaggcataagctgaacactttccacgtgcgcatggaagacgatgcccaagtgggccagggggaagacttgcggaagttcattctggccgcgctcagtgccagccacagaaacgtggtaaactgtgccctgtgccaccgggcgctcccggtgttcgaacagttcccactggtggatggaactttgttcctaagcccgtcgagacatgatgagatcgaatatgatgttccttgtcaccttcaagggagactcatgcatctgtatgccgtgtgcgtggactgcctggaaggggttcacaagatcatctgcatcaagtgtaagtcacggtgggatggcagctggcaccagctgggcactatgtacacctacgacatcctggctgcctctccatgttgtcaggcccgcctgaactgtaagcactgtgggaagccggtgatcgacgtgaggatcgggatgcagtacttctccgaatatagcaacgtccagcagtgtccacactgtgggaacctggactaccacttcgtgaagccattttcctccttcaaagttctcgaagcttattgatgaaagctttgctttagtaatagctattttattgatattattactttattacatatcttttatagggaaacattctgtgacattaatttcctttctaatttaaaggagagttactttgttgtatgtgtgccactaaaataggggctgcccttgccctgtcttgattcccgagtgttaatctgtggttttgaccagagcccagatgggtaatcctgtgcatttgggttggggttcactcttaccaagaatctttgatgcagctttaagatggtggggaggatggggtgaatttaggaaaggaatttgtggttataaactaagagcttgataggagttggaaggaaactcttactaaaatgttaactttctaaaaaccttcttttagatcttccttgggcctttggaaaaatatgtgacaagtgaatgtaagtctgtgcctggagagctaatagtgcattagtctatctcagcctagtgttctgcagcacacatgggcaggcagtttactcacactgacaggtgacctgaaagtggcacaagtgctgtttctatcactattgtaatttgccagttcatttttcatgctgaaagtaatatccaaattgtaagacatatgaaagatattagtgttgcaaatatgtttaggtaaactgacctataacagaatatgtgaaatgaatttggaaataatgcaagaaggcagaactcaatcatttaaattgtgtctttgaagttggtaatatagcttttaaggagaacccatgaataacctgatttgggcagtgatgatttattacaggttgcactgttgaagtgtcatttggtgtcaggttcttctcacaggtaaatctttcagccacagaatctaactggtgagcttcagaaccaataattgccacatttattgtcctcaaaattgcttatggccatgtttaaccaattaattctgagtttccaaaatcaaagatttgaccttaagagggaagggaaaaaagtgtgaaaggatgatgaagaaaataattttactatttcttttaaaagtatgttttggaaaatcaatgattttaatgcatagcagtatgtttgaaaaatagaccattctaaaaagcccatgataccttactgttgatgaaaaaggatgatcatatatatagaacttgattagtcagagcattgggcattccaaaatacagcctttggttcagtagattttaatgctttaaatagactgacgtcgcatacccttatagaattggaatatgatttctcaaaaattaatttgataatttcatgtatgatgtgcatatatgctaaaagaatgcagaaaatcattttatgaatagccaaatttggggttgatgtgaacattttatgttactcatttggtttatacttttttttttttttttttaactgtgtggtttttcttttcagaagtatttaggcaatattgcacgtgagtttcagttctttttttcttttttttgagatggagtctcactcttgtcacccaggctggagtgcagtagtgcgatctcagctcactgcaacctctgcctcctggattcaagcgattctcctgtcccagcctcccaggtagctgggactataggcacgtgccaccacacccggctaattttttgtatttttagtagagacagcgtttcaccatgttagctaggatggtctagatctcctgaccttgtgatctgcctgcctcggcctcccaaagtgctgggattacaggcgtgagtcactgcgcctggccaagtttcagttctatatgaagtatttgatgttttgtttgaaacaatacagcattaaagaaccaatgttattcactaatatcattcatctttcagtttggatgatttggtttgctgcatctaggtcggtgtttgatcatctgaaaaaacatttcagtgggaagaaatgcataaaatgcctataagaagtagaaagtcattgaactgacagtgtttgatgcaactaaaagaggattgtaagcatagctttctgcaaacttgtctttaatgcacaaagctgtagtggtgaattaactatctccttattgattctctcctgtacccagatgcaaaaagtgctaagtttctcttgtcctcgtaataccatttggattttatttctgaatttaaatagtaaaatatttatgatgctgatctttaacccacctaaaattttatagtgaaacctgctttatattgttgttctgaagcttacaattgacctatacattgcattcagcaagctcctgaatttagaactgccgtcagtgtagtgtatgctgtgttccatgttgcctttttagatggctttctaccccctgaacaataaataggatgaggttttactgtaattgggtaaagtttactcttggacattatttcgatgctaaagtaaggattctgtggatgttacttaaagagaaaagcataagagcatgaagcatatctgggaatatcttttgcctttaagacgattcattcttgtctagagggaaaatctggctgatttgggaataaaatataatcgaatattcaacaccatgaagataaatcttattttggaaatctactgaccttaataccccaagcttgccctgaatactttgattggaattggaatatatcaaaaaaggttagtatttttgttgtagttaggatactaaaaggatattagttacccaagagatccaatttgtttttctgatgaatagtgttcagtaaaatgaagcagtcttaagagtgactaataatttcaaagtgatttttcgtctattcttaatattttttaattatttatttttaagagttttataccttgagcagatacaatgatctgctttagtgagaggacaatttctgattgattgttttctcttcaggccatctcacctcttcattctcttgttacatttgaagcagttgatataatgggtttatactttaaaagatagacatggtgccatgaagttggggagttgggtgaattatcccattctagttacagaggagctttccttaaatgccctttaacttctaggttttgttcaagaagttcattttctgagtaaaagttattttcatatatgttgggggaaaattaactcatctaaaaagaatcttattaggtatttgaactctaaaactaacagataagacagatatgtaccttattagagcaccagaactaatttgctaagtcttttgtttagtcctgcaagactgatgcttaatacacagtctgttctcctgtgtctaggtcaggaactccagtttgcttttctgttttgtgtcctggtagcagctgttgagtaactttcattggaggttgggaaggaagtgaggagaaagtgttcttgtttagtgttttatttcctataataggatgctgcctaacccagttcatctctatgtcctgttcactgaatattccgggtaattgaaagaaaatataatggatgggctccattaaaaccagctcaaaaataaattcttgtcagtaaagatttcttgtcaagatgtcttggattgcacttttgttgaggaaagacagtgtaaatagttaaagaatgttgataaaattgaaacatttggttgtggaattgtgtgtggttttagagggtttctgtttgtgaaatgtatgtattaaaaataataaaattccagaaactaaaaaaaaaaaaaaaaaaaaaaa

SEQ ID NO: 504 - DNA, 6619 bp, Homo sapiens
gaattcccttacaaacgcctccagcttgtagaggcggtcgtggaggacccagaggaggagacgaaggggaaggaggcggtggtggaggaggcaaaggccttggacgaccattgttggcgaggggcaccactccgggagaggcggcgctgggcgtcttgggggtgcgcgccgggagcctgcagcgggaccagcgtgggaacgcggctggcaggctgtggacctcgtcctcaccaccatggtcgggctccttttgttttttttcccagcgatctttttggaggtgtcccttctccccagaagccccggcaggaaagtgttgctggcaggagcgtcgtctcagcgctcggtggccagaatggacggagatgtcatcattggagccctcttctcagtccatcaccagcctccggccgagaaagtgcccgagaggaagtgtggggagatcagggagcagtatggcatccagagggtggaggccatgttccacacgttggataagatcaacgcggacccggtcctcctgcccaacatcaccctgggcagtgagatccgggactcctgctggcactcttccgtggctctggaacagagcattgagttcattagggactctctgatttccattcgagatgagaaggatgggatcaaccggtgtctgcctgacggccagtccctccccccaggcaggactaagaagcccattgcgggagtgatcggtcccggctccagctctgtagccattcaagtgcagaacctgctccagctcttcgacatcccccagatcgcttattcagccacaagcatcgacctgagtgacaaaactttgtacaaatacttcctgagggttgtcccttctgacactttgcaggcaagggccatgcttgacatagtcaaacgttacaattggacctatgtctctgcagtccacacggaagggaattatggggagagcggaatggacgctttcaaagagctggctgcccaggaaggcctctgtatcgcccattctgacaaaatctacagcaacgctggggagaagagctttgaccgactcttgcgcaaactccgagagaggcttcccaaggctagagtggtggtctgcttctgtgaaggcatgacagtgcgaggactcctgagcgccatgcggcgccttggcgtcgtgggcgagttctcactcattggaagtgatggatgggcagacagagatgaagtcattgaaggttatgaggtggaagccaacgggggaatcacgataaagctgcagtctccagaggtcaggtcatttgatgattatttcctgaaactgaggctggacactaacacgaggaatccctggttccctgagttctggcaacatcggttccagtgccgccttccaggacaccttctggaaaatcccaactttaaacgaatctgcacaggcaatgaaagcttagaagaaaactatgtccaggacagtaagatggggtttgtcatcaatgccatctatgccatggcacatgggctgcagaacatgcaccatgccctctgccctggccacgtgggcctctgcgatgccatgaagcccatcgacggcagcaagctgctggacttcctcatcaagtcctcattcattggagtatctggagaggaggtgtggtttgatgagaaaggagacgctcctggaaggtatgatatcatgaatctgcagtacactgaagctaatcgctatgactatgtgcacgttggaacctggcatgaaggagtgctgaacattgatgattacaaaatccagatgaacaagagtggagtggtgcggtctgtgtgcagtgagccttgcttaaagggccagattaaggttatacggaaaggagaagtgagctgctgctggatttgcacggcctgcaaagagaatgaatatgtgcaagatgagttcacctgcaaagcttgtgacttgggatggtggcccaatgcagatctaacaggctgtgagcccattcctgtgcgctatcttgagtggagcaacatcgaatccattatagccatcgccttttcatgcctgggaatccttgttaccttgtttgtcaccctaatctttgtactgtaccgggacacaccagtggtcaaatcctccagtcgggagctctgctacatcatcctagctggcatcttccttggttatgtgtgcccattcactctcattgccaaacctactaccacctcctgctacctccagcgcctcttggttggcctctcctctgcgatgtgctactctgctttagtgactaaaaccaatcgtattgcacgcatcctggctggcagcaagaagaagatctgcacccggaagcccaggttcatgagtgcctgggctcaggtgatcattgcctcaattctgattagtgtgcaactaaccctggtggtaaccctgatcatcatggaaccccctatgcccattctgtcctacccaagtatcaaggaagtctaccttatctgcaataccagcaacctgggtgtggtggcccctttgggctacaatggactcctcatcatgagctgtacctactatgccttcaagacccgcaacgtgcccgccaacttcaacgaggccaaatatatcgcgttcaccatgtacaccacctgtatcatctggctagcttttgtgcccatttactttgggagcaactacaagatcatcacaacttgctttgcagtgagtctcagtgtaacagtggctctggggtgcatgttcactcccaagatgtacatcattattgccaagcctgagaggaatgtccgcagtgccttcaccacctctgatgttgtccgcatgcatgttggcgatggcaagctgccctgccgctccaacactttcctcaacatcttccgaagaaagaaggcaggggcagggaatgccaattctaatggcaagtctgtgtcatggtctgaaccaggtggaggacaggtgcccaagggacagcatatgtggcaccgcctctctgtgcacgtgaagaccaatgagacggcctgcaaccaaacagccgtcatcaaacccctcactaaaagttaccaaggctctggcaagagcctgaccttttcagataccagcaccaagaccctttacaacgtagaggaggaggaggatgcccagccgattcgctttagcccgcctggtagcccttccatggtggtgcacaggcgcgtgccaagcgcggcgaccactccgcctctgccgccccacctgaccgcagaggagacccccctcttcctggccgaaccagccctccccaagggcttgccccctcctctccagcagcagcagcaaccccctccacagcagaaatcgctgatggaccagctccagggagtggtcagcaacttcagtaccgcgatcccggattttcacgcggtgctggcaggccccgggggtcccgggaacgggctgcggtccctgtacccgcccccgccaccgccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacacggaagaagacgaactggaagaggaggaggaggacctgcaggcggccagcaaactgaccccggatgattcgcctgcgctgacgcctccgtcgcctttccgcgactcggtggcctcgggcagctcggtgcccagctccccagtgtccgagtcggtgctctgcacccctcccaacgtatcctacgcctctgtcattctgcgggactacaagcaaagctcttccaccctgtaagggggaagggtccacatagaaaagcaagacaagccagagatctcccacacctccagagatgtgcaaacagctgggaggaaaagcctgggagtggggggcctcgtcgggaggacaggagaccgctgctgctgctgccgctactgctgctgctgccttaagtaggaagagagggaaggacaccaagcaaaaaatgttcaggccaggattcggattcttgaattactcgaagccttctctgggaagaaagggaattctgacaaagcacaattccatatggtatgtaacttttatcacaaatcaaatagtgacatcacaaacataatgtcctcttttgcacaattgtgcatagatatatatatgcccacacacactgggccatgcttggcaaggaacagaccacgtggcatccagtcggatcatgagttcacctgatgcattcggagtgagctggtggagccagacagagcaggtgcggggaagggaagggccaggccagacccatcccaaacggatgatgggatgatgggacagcagttccttgctcagaagcccttctccccgctgggctgacagactcctcatcttcaggagactcaggaatggagcggtacaggggtctctcttcatccaccgcaacccatccagtgccagctttgagattgcacttgaagaaaggtgcatggaccccctgctgctctgcagattccctttatttaggaaaacaggaataagagcaaaattatcaccaaaaagtgcttcatcaggcgtgctacaggaggaaggagctagaaatagaacaatccatcagcatgagactttgaaaaaaaaaacacatgatcagcttctcatgttccatattcacttattggcgatttggggaaaaggccggaacaagagattgttacgagagtggcagaaacccttttgtagattgacttgtgtttgtgccaagcgggctttccattgaccttcagttaaagaacaaaccatgtgacaaaattgttaccttccacttactgtagcaaataatacctacaagttgaacttctaagatgcgtatatgtacaatttggtgccattatttctcctacgtattagagaaacaaatccatctttgaatctaatggtgtactcatagcaactattactggtttaaatgacaaataattctatcctattgtcactgaagtccttgtaactagcgagtgaatgtgttcctgtgtccttgtatatgtgcgatcgtaaaatttgtgcaatgtaatgtcaaattgacctgtcaatgtcaacctagtagtcaatctaactgcaattagaaattgtcttttgaatatactatatatattttttatgttccaataatgttttatacatcattgtcatcaatatctacagaagctctttgacggtttgaatactatggctcaaggttttcatatgcagctcggatggacatttttcttctaagatggaacttatttttcagatattttctgatgtggagatatgttattaatgaagtggtttgaaaatttgttatattaaaagtgcacaaaaactgagagtgaaaataaaaggtacattttataagcttgcacacattattaacacataagattgaacaaagcatttagattattccaggttatatcatttttttaaagattttccacagctacttgagtgtctaacatacagtaacatctaactcagctaataatttgtaaaatctttatcaatcacattgtggcctcttttaatttttatgttcatggacttttattcctgtgtcttggctgtcataactttttatttctgctatttgctgttgtgtaatatccatggacatgtaatccacttactccatctttacaatccctttttaccaccaataaaaggattttttcttgctgttttgatttcttctattatttgtggaatgaattataccccccttaaatatctttgtttatgccttatgttcagtcatattttaatatgcttccttcatattgaagctgctgatttctcagccaaaaatcatcttagaatctttaaatatccattgcatcatttgttcagaatttaacatccattccaatgttggaggcttgtattacttatatttcatcatattctattgccaagtttagtcagttccacaccaagaatgaactgcatttcctttaaaaattattttaaaacacctttattgaaaagatctcatgactgagatgtggactttggttccatgttttcattgtaagaaagcagagagcggaaaatcaatggctccagtgattaatagatgggtttttagtaattgacaaattcatgagggaaagcatatgatctctttattagtgaatcatgcttattttttactcttaacgccactaatatacatccctaatatcacagggcttgtgcattcagatttttaaaaaattaggatagataaggaaacaacttatattcaagtgtaagatgatatcaggttggtctaagacttttggtgaacacgttcattcaactgtgatcactttattactctgaatgcctactattatcctgattatggggtctcctgaataaatagagtattagtctttatgtcatcattgttcaaaattggagatgtacacatacataccctataccaagagggccgaaactcttcaccttgatgtatgttctgatacaagttgttcagcttcttgtaaatgtgttttccttcggcttgttactgccttttgtcaaataatcttgacaatgctgtataataaatattttctatttatt

SEQ ID NO: 505 - DNA, 1549 bp, Homo sapiens
cgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagatttagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaagccaaaggtcattccaaatgctatatgtggaatttgtctgaagggtaaggagtccaacaagaaaggaaaggctgaatcacttatacactgctcccaatgtgagaatagtggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgc

SEQ ID NO: 506 - DNA, 1583 bp, Homo sapiens
cgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaagccaaaggtcattccaaatgctatatgtggaatttgtctgaagggtaaggagtccaacaagaaaggaaaggctgaatcacttatacactgctcccaatgtgagaatagtggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaaaaaaaaaaaaaaaaaaaaaaaaaaaaaaaaaaaaaaa

SEQ ID NO: 507 - DNA, 1549 bp, Homo sapiens; identical to SEQ ID NO: 505

SEQ ID NO: 508 - DNA, 1583 bp, Homo sapiens; identical to SEQ ID NO: 506

SEQ ID NO: 509 - DNA, 1438 bp, Homo sapiens
agcacttcctcatagaccttggatgtgggaggattgcattcagtctagttcctggttgccggctgaaataacctgaattcaagccaggaagaagcagcaatctgtcttctggattaaaactgaagatcaacctactttcaacttactaagaaaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttagaataaggagtaaaacaatcttgtctatttgtcatccagctcaccagttatcaactgacgacctatcatgtatcttctgtacccttaccttattttgaagaaaatcctagacatcaaatcatttcacctataaaaatgtcatcatatataattaaacagctttttaaagaaacataaccacaaaccttttcaaataataataataataataataaaaaatgtattttaaagatggcctgtggttatcttggaaattggtgatttatgctagaaagcttttaatgttggtttattgttgaattcctagaaaagttttattggtagatgagtaaataaaatattgtaaaaaaacttattgtctataaagtatattaaaacattgttggctaataaaaaaaaaaaaaaa

SEQ ID NO: 510 - DNA, 2886 bp, Homo sapiens
tgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccaggctgcagtaatgtgttggtagttacacttgaggcatttttttgttgttgttaattaactctatagtctcaaactatttttgcaaatatatcatttttcctaattggttcttgacgtgcagtggactggctctgtgaatgattggcagggtcttagttttgcgagagcatttccttctaagaattattgtgatctgcagaaacagccatttgattcaaaaatcatgtagaaaaggagtaggagaagcaaaacgtttcatttttgggccttaaccatttgaaatgtttggactttaaacataaagccatggagtttataaagccaagtaaccatttgatatggataataatatctactctagagagagtatatatatgcacattgatttttaatgctgttaagatacttttgtaaaactgtaggaacaagagtaattagaccaaattgaagcttaggggacagtaaagtggttgctttccatttagggtaaccatgcatgtggttagtcctctcctcctgagattcagaaccagttgactgtccccttaggtgtataaggagaaaagttgacatgtctgggacctctgacatgtgtacacatgcttgcacacatgcacacacagtgaatgttttaagttatacaaacataagaccttaagatgcaaagagccagaatattctaaagaggtgatgaacagagggggtggaaactgcatcacagatgttttccaagggccagggtggaatctgagctctagtgtctgactttgagatgcattatatttttaacacataaatgaggggatccatatcacattctttcttgtggaccaccaaattgaaggctttcttgtaattcacaagcagcagctctccagcatctctccgtagcctgggtgaagtcccagaagctggtgtgcatcattttccaaggtggcagagctgcttgctctgcagatcattcctttgagagaggagtacaagtgaagaaacaaggaggcacttcctgtaggagcactgatgtgccttgtccacactcccctctgagctttactggtaagagagctccgactgaacatgctgagcagttgagcacttttccatcagcaacaacagcgaggatggaaatggaaaggaaccgaactaaaatgcatttccctttgcagggcagagagctaagctcttaggaatagtgttatagaaataagcaccctaacttcaattcctgaaaatgttggttaatggagagaattttggagtttcacttaatattttcccatcggtcgccataaataagtcttcaggcgctcctagaagagtcccagcccaaggctcgattaaggaccacactgcaggtctgaggctcactgctctgagtcctgaacaccagagccctgcagagagtggtgataacacatcatctctgcaaagaggaacctctcccccggccgccacttcactcaggcttctactgagcagcaaggacagcctgggtttcaaatgccacttcccctgctttagggatccaggtgtcctgatagcgtgaccctgctgaggcaaggtatcaactccgagagtgactgagtcactgagcgtggcacatgaacaaacgtcatgacaaagattctctgagtgaagttaacaccacgtattttacctttgcaaaaaacaaactggcaccctgagttctaactacggacggacgatatctttgcctccacacccagattcctggaaatggctaacgtttcctttctaggggaagggtcgaggaatactcaagtgctagcttagcagctttgttcagtccagatcagagctgttaggtaaaggcctaaccacctccctgcagtctcttatatctcaagctttaggaacccatttctaaatgtacactagcggagaatttatattgtcagccttgattaccataggacaggcagaaaggcgataatttgtatcttttaatataaaagaagcttttaacttttccagcctattataataactgagttatattcactgtggctcaaactaattggcattgtggaacatttctttaccttcaaagttttctccaccaatcatttcagttctattgcagtcctggtgccatatgtcccctgcaaattgtgaaagtaattagtgacaaaatagcagcctgctccttttcaatggcgaaactgtcggcattagcagttttgggtaagctggcggtactataacacgtactggaaacctgttcctcatcaccacctaccagattctggaaatgccgtcttctagaaaacgatggcgtttgtggtggtcttcttttgaaaggaacagtaatttgtgtggatattgttaaagtgtttaaagaatattttgacaattaagtttacattttacaattgctttattttttattaaaatagttgtatataaatattaccctatttcactgttgttcaagtaaatctaaaccttgtagacaagtgagtcatctgatatgtatagaagctgtgatatatagagtacatttattgtgtaaatgtttatgaatataattgttcctgtgtttttataagttggggatattttgttgttttacggcaacaaaatttattgcatttaaatggtttttatgtaatagaaatcacgcaaaatagtgaaggatttaaaatatgtatatgatacatgtaaatgtacaaactttagaaagaaataaatccaacaaatttcaaaaaaaaaaaaaaaaaaa

SEQ ID NO: 511 - DNA, 8436 bp, Homo sapiens
aacaaagagcacgcggcgctggccgccggcactcgcgccctgaggctgcggccccggagcgcccggcggcggtttcggcgcgcggccgggctggcgatggaagatggaaggaaggagcgcagcggcagagacatttgtttgggtgaacaatgcatctgcacattcccagagtgttgccaaggccaaatatgaatttttatttggcagatctgaagggaaagctccagatactagtgatcatggaggaagcactttactcccaccaaatgtcacaaatgaatttccagaatatgggaccatggaggaaggtggagaaggcctaagggcttctctggaatttgatggtgaggctctgccatgccacccacaagagcagcagggtgtccagcctcttactggctgccactctgggctcgacagtgttacagaaggaccaaaagatgtcagagaggccccctctcaaagtcatctcaaggaacaaagtttacagcccattgactctttgatttcagctctgaaagccacagaagccagaatcatttccggaacattacaggctacaaaggtactggaccaagatgctgtttctagtttttcagttcagcaggtggaaaaagagctggacactgccagtcgtaaaacacagagagtcaacaaactgctccctgctggccaaaaaaatttaccagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggatcagcgaacaagaggagcacgttaagggggaagatgaagacatccttgggcctggatatacggaggactccaccgacgtgtacagctcccagtttgaaaccattttggacaacacttctttatactacagtgcagagtccctggagacattatactcagagcctgatagctattttagctttgaaatgcccctcactccaatgatacaacagcgcattaaagaaggtggtcagttcttggagaggacatcagggggaggacatcaggatatcctgagtgtgtctgcagatggtggcatcgtgatgggctattctagtggcgtcaccaatgggctgaatgatgccagcgactccatctacacgaaaggcaccccggagattgctttctggggaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccaaatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtgtcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacgagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaccagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattgctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaagaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtccataaaaaa

SEQ ID NO: 512 - DNA, 3054 bp, Homo sapiens
gcctcccagcacgctggtcagctcctcttgctcgcaagcaggtctggccccagcggcgcgaagtcacgaggctgggggcggccggcggcgaagggggcggggcgaggccgggcgccgcagcgcgcataggcggagcctcggccgcgggccgccttggtatatctgcgtgcgcgcgtctgctgggccagtcgggacagaggagacaagatggcgctgcgggcgatgcgggggattgtcaacggggccgcacccgagctacccgtgcccaccggtgggccggcggtgggagctcgggagcaggcgctggcagtcagtcggaactacctctcccagcctcgcctcacatacaagacagtatctggagtcaatggtccactagtgatcttagatcatgttaagtttcccaggtatgctgaaattgtccatttgaccttaccggatggcacaaagagaagtgggcaagttctggaagttagtggttccaaggcagtagttcaggtatttgaagggacttcaggtatagatgctaagaaaacgtcctgtgagtttactggggatattctccgaacaccggtgtctgaggatatgcttggtcgggtattcaatggatcgggaaaacccattgacagaggtcctgttgtactggccgaagacttccttgatatcatgggtcagccaatcaaccctcaatgtcgaatctacccagaggaaatgattcagactggcatttcggccatcgatgggatgaacagtattgctagggggcagaaaattcctatcttctctgctgctgggctaccacacaatgagattgcagctcagatctgtcgccaggctggtttggtaaagaaatccaaagatgtagtagactacagtgaggaaaattttgcaattgtatttgctgctatgggtgtaaacatggaaactgcccggttcttcaaatctgactttgaagaaaatggctcaatggacaatgtctgcctctttttgaacttggctaatgacccaaccattgagcgaattatcactcctcgcctggctctaaccacagctgaatttctggcgtaccaatgtgagaaacatgtattggttattctaacagacatgagttcttatgctgaagcacttcgagaggtttcagcagccagggaagaggtacctggtcgacgaggttttccaggttacatgtatacagatttagccacgatatatgaacgcgctgggcgagtggaagggagaaacggctcgattactcaaatccctattctaaccatgcctaatgatgatatcactcaccccatcccagacttgactggctacattacagaggggcagatctatgtggacagacagctgcacaacagacagatttatccacctatcaatgtgctgccctcactatcacggttaatgaagtctgctattggagaagggatgaccaggaaggatcatgccgatgtatctaaccagctatatgcgtgctatgctattggaaaggatgtgcaagccatgaaagctgtcgttggagaagaagcccttacctcagatgatcttctctacttggaatttctgcagaagtttgagaggaacttcattgctcagggtccttacgaaaatcgcactgtctttgagactttggacattggctggcagctactccgaatcttccccaaagaaatgctgaagagaatccctcagagcaccctcagcgaattttaccctcgagactctgcaaagcattagctgctgcttctgcattgctccgcgctcttgtgaaatactggttctgttttctttattccttttgcactctcggttcccacctttgtgttggagtttaccatgttaccctgtaattaaaaacaaagaataggtaacatattgtgccagtgttgcaacgttttaaactgctaacagaccttaaaatatccccctacctgggtcctcagtgctatgtttaaagtgctgcagggatggagtggcgttttcttattgctgtatgtattgtacatagtggagtagttagttacctgataacagtcttgttatttgggtctcttagaccttacctctcaactccctcaagagtaccagtctctgaagttataatgctttggtctctacattaggggcaagatccagtctgagagaagtctcctttgagaagggccaagaggctctttcctgagtgtttgctttcggtttgttggtatgcctgtattgctgggctgtgctgctgctcgaagcagatggttttgactgtctttttgctctttcctatataatgaatagatgagtgaaaggagttttctttttctctttagtacttacgtattgggattcctgtgtcttacagctctccctctccaaataatacacagaatcctgcaactttttgcacagctggtatctgtctggtagcagtgagaccccttgtcttggtgatccttactgggtttccaagcagaggagtcacatgattacaattgccagtagagttgttgtttggggtacaagatgagaagaaagaaaaacctacagcctttctacattctgacatgctaacagtggtttaagtttctaaagtgtttaccagatgctgaaggcaaggggagggagcagaagcacttatgtttacggatattttaaactctgttagagagcagcctttgaaaatccccaatttggttctgctttttgacctctctctaccttttcagggtaatctttgtggcacaaacgatagcatttccaagctttagagttttctgaattcctgcgccttcctgacgtgagccctgagcgatcttctatgcagttctgccatgcgtcctgttggtctctctgtgttctttgttacttgggtgcaatagcaacttccctaccccgtgcattccatctttcatgttgtgtaaagttcttcacttttttctctgagggctgggggttgggggagtcagcatgattatattttaatgtagaaaatgtgacatctggatataaaatgaaaataaatgttaaattaaatggaccttaaaaaaaaaaaaaaaaaaa

SEQ ID NO: 513 - DNA, 6172 bp, Homo sapiens
ggcgggtccctgagctggaagccggagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagcaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagcccgtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccgactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgttcccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaagtattatgcctacctgtattcttatgtgatgccccaggccatccgggacatggtggatgaatacatcaactgtgaggacattgccatgaacttccttgtctcccacatcactcggaagccccccatcaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactc

SEQ ID NO: 514 - DNA, 6172 bp, Homo sapiens; identical to SEQ ID NO: 513

SEQ ID NO: 515 - DNA, 2540 bp, Homo sapiens
aggtggcggagattgcaccggaagacgcttcctgggtttgaggagttcagtgactgctattgaaccaccaaaagtccattatgaaactgtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaaggagctaaaggagtgctcgggtcatgtatttgtggattctgtgccggaattctgtttaccagagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggctgttaccttctcctctcaaggatgcagtggaagtctcaacctggagaagatgctatacaatgcaagaggtgaactctgcccttagtaaaatccagctggtgggatattctcagaaaattgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgcccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacggaaccagacttctcctacctggaagccctggctccttaccagccgctggccatgaaatgcatctactgccccatcgacacccggctgaacttcatccaggtgtcaaagctgcttaaagaagtgcagcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaacttcaggctcattttcttctcaactctggctctctcaaggagctggagggtgacagaagtgggacaggagaagttttccaagaggttcatgggaggcggaggtgactggctggctgtcttgcatcagtcccaggcctcggccaggggagccagcctttggtttcgtttacttgcctacagtgctgtacgcaataagatgatgatcccaaaatatggtaaagtgaacccatctgtctgcattttctactctgagcccatttgttaataaacacttatttttatat

SEQ ID NO: 516 - DNA, 1977 bp, Homo sapiens
acgggccgcagcggcagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatca

SEQ ID NO: 517 - DNA, 2701 bp, Homo sapiens
ccgccgtagcgcgtcttgggtctcccggctgccgctgctgccgccgccgcctcgggtcgtggagccaggagcgacgtcaccgccatggcaggcatcaaagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgattgagtggggagcttgtgcacttgttctcacaggaaacacagtcatctttgcaactatactaggctttttcttggtctttggaagcaaggacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttggaaaagcttgactgatttcacacttatctatagtatgctttttgtggtgtcctgctgaatttaaatatttatgtgtttttcctgttaggttgattttttttggaatcaatatgcaatgttaaacacttttttaatgtaatcatttgcattggttaggaattcagaattccgccggctctattactggtcaagtacatcttttctcttaaaattatttagcctccattattacaaaaaattataaaaataagttttcagtcagtcaggatgacatcactcccaatgttatgcagacatacagacggttggcatacgttatagactgtatactcagtgcaaatatagctgcatttatacctcagaggggccaagtgttaatgcccatgccctccgttaagggttgttggttttactggtagacagatgttttgtggattgaaaattattttatggaattgctacagaggagtgcttttcttctcaattgttagaagaatttatgttaaactttaaggtaagggtgtaaaaacatttttgagataaggtttttatttatgtttattattgttagagtgagttgcaatgtgggaagaaatgacattgaaattccagtttttgaatcctgtttctatttataagtgaaatttgtgatctcctatcaacctttcatgttttaccctgttaaaatggacatacatggaaccactactgatgagggacagttgtatgtttgcatcatatatgccagaaaaccttcctctgcttcctccttttgacttatttggtatgttgtatatattacataaaataacttttcaaatatagtttaataacacttagaagtgtttacttacctggaaaataattgctatgccgtacattcagagtgccccctcccctgcaaggccttgccatgattaacaagtaacttgttagtcttacagataattcatgcattaacagtttaagatttagaccatggtaatagtagttcttattctctaaggttatatcatatgtaatttaaaagtatttttaagccaagtttcctgtatacctctgaactgttttgattttgagttcatcatgatagatctgctgtttccttataaaaggcatttgttgtgtgagttaatgcaaagtagccaagtccagctatatagcagcttcagaaacatacctgaccaaaaaattcccagtaaccaggcatgatcaatttatagtggtcgtttacatctaataattatcaggacttttttcaggagtgggttataaaaacattcaagttggtctgacagtattttgttaaggatatttgtttgtatgtttattcagtatacttacataaaaattatttcgccatcagccaaaactcagtaatcatgacagctgtctgttgttttatgaagtttatttctcaagaaaatgggaataaatttgggatttgttcagcttttttactaaagatgcctaaagccacaggttttattgcctaacttaagccatgacttttagatatgagatgacgggaagcaggacgaaatatcggcgtgtggctggagccttcccactggaggctgaaagtggcttgtggtattataatgttcagatttcaagaggaaggtgcaggtacacatgagttagagagctggtgagacagttgggaactctttgtgcttgtgatctactggactttttttttgcaggaagtgcattctctggtccttccctattttctgttctggatgtcagtgcagtgcactgctactgttttatccacttggccacagactttttctaacagctgcgtattatttctatatactaattgcattggcagcattgtgtctttgaccttgtatactagcttgacatagtgctgtctctgatttctaggctagttacttgagatatgaattttccatagaatatgcactgatacaacattaccattcttctatggaaagaaaacttttgatgatgaaacaataaagattttaaatatcaaaaaaaaaaaaaaaaaa

SEQ ID NO: 518 - DNA, 1044 bp, Homo sapiens
caaccctgccaggctctccaatcgcatgtggaattatcgctctacccaggcggtggtgtcgatctacgttccaattggggccgtaccatggcggagaagactcaaaagagtgtgaagattgctcctggagcagttgtatgtgtagaaagtgaaatcagaggagatgtaactatcggacctcggacagtgatccaccctaaagcaagaattattgcggaagccgggccaatagtgattggcgaagggaacctaatagaagaacaggcccttatcataaatgcttacccagataatatcactcctgacactgaagatccagaaccaaaacctatgatcattggcaccaataatgtgtttgaagttggctgttattcccaagccatgaagatgggagataataatgtcattgaatcaaaagcatatgtaggcagaaatgtaatattgacaagtggctgcatcattggggcttgttgcaacctaaatacatttgaagtcatccctgagaatacggtgatctatggtgcagactgccttcgtcgggtgcagactgagcgaccgcagccccagacactacagctggatttcttgatgaaaatcttgccaaattaccaccacctaaagaagactatgaaaggaagctcaactccagtaaagaactaagaacagtgtataacatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggttcttttctgataatttacagatttagcttttcttttgttatataaactgctagccacaaattttagttatgtaaaaggctacccttgacaagaaaagacatactgtcatgtatttatattctagcatagactaaactgaataaaaatgctgataacaggacctttaaaaaaaaaaaaaa

SEQ ID NO: 519 - DNA, 1594 bp, Homo sapiens
atcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggttccccgctgccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagatgcgctggctccctccctccgaggctacttctcagggctggaagtcccgtcagttctgctgaatactatacccttcagcaatggctactagaaggacgaacaattgccctcctttggaagtacggctaatagaagccctagatccgaataagatccgaataagaatatgtaatggaccaggcgcagtgcctcacgcctgtcatcccagcactttgggaggctgaggcaggcggatcacttgatgacagaagtgtgagaccagcccagccaacatggtcccaggtgtgtgatggcggctgcaatctgtcttgtgggtattaatgcaatcttcagtggtggctactgttctctagctgttctacaaaactggagcatgctggcttgaaaaacccttgcccagtttggatcccttcaagactttgtcacagcctctatcacacatctgtttttctcgaagaaaaaaatataattaataaaaatgttttactcttttacactg

SEQ ID NO: 520 - DNA, 1623 bp, Homo sapiens
cgggaagtggcgggcggagtcccgggtccagtcgccgcctcagctaccgccgctgccgccgccgccgccgccaccgccagtggtgagaccccgacctggcgggtcagcgctgggcgtgcgtgcgggcaggcgggggcgctgacgagaagcaggaagagggtgcagtgccggcgtgggcggccggccgaggcggaggcgcaggaagggggcggcgagtcgtgcgaggctgcccttctcactcagcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctgatcatagcaatggatcatttaacttgaaagctttgtcaggaagctctggatataagtttggtgttcttgctaagattgtgaattacatgaagacacggcatcagcgaggagatacgcatcctctaaccttagatgaaattttggatgaaacacaacatttagatattggactcaagcagaaacaatggctaatgactgaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaagcactgcccaattcccagaaagctgtcaaggctttgggggaccagatactatttgtaaatcgtcccgataagaagaaaatacttttcttcaatgataagagctgtcagttttctgtggatgaagaatttcagaaactgtggaggagtgtcactgtagattccatggacgaggagaaaattgaagaatatctgaagcgacagggtatttcttccatgcaggaatctggaccaaagaaagtggcccctattcagagaaggaaaaagcctgcttcacagaaaaagcgacgctttaagactcataacgaacacttggctggagtgctgaaggattactctgacattacttccagcaaatagggaacagttttgccctggaacagagttacagatacacaatcaagagtgttcttgctgatgctcggggtctgaagactgtcttcctatctgcttcttgcggctgaggagaggagcagttcagtttacaaaacaagtgcaaattaccaaactcaaagcttatttgagtagaatgggctcatgggcaatgtgatgttccctgttaaccttctgttactccctgggagaaaggcgctgagcgtggcatgcaggtgtctttgctgtgtttttctccacttctaaatggttcctggttcctttcttcctcgtttgttactttagagcaagtttgcccatagtcttgaatgcaatatttgtttattccaaaagaacatatttataataaaatcactgtagaaggatttttaaaaaaaaaaaaaaaaaaaaaaaaaaaaaaaaaaaaaaaaaaaaaaaaaaaaaaaaaaaaattaaaaaaaaaaaaaaaaaaaaaaaaaaaaaaaaaa

SEQ ID NO: 521 - DNA, 1618 bp, Homo sapiens
gagcgccggcgcgggaccgagctggcggcgggcggcgcgcgcttccgaggcttcctgctgcttctgcccgagcccgcggcctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggccgcagcgtcattgttggtgcaggttacattgctgtggagatggcagggatcctgtcagccctgggttctaagacatcactgatgatacggcatgataaggtacttagaagttttgattcaatgatcagcaccaactgcacggaggagctggagaacgctggcgtggaggtgctgaagttctcccaggtcaaggaggttaaaaagactttgtcgggcttggaagtcagcatggttactgcagttcccggtaggctaccagtcatgaccatgattccagatgttgactgcctgctctgggccattgggcgggtcccgaataccaaggacctgagtttaaacaaactggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttgagaaccaggagacacgtgtggcgggcagtgggacccatagatcttctgaaatgaaacaaataatcacattgactt

SEQ ID NO: 522 - DNA, 1482 bp, Homo sapiens
gcacgagccgccaccatggcttcacgtggggttgttggcattttcttcctctctgctgtcccccttgtgtgtctggagctccggcgtgggatcccggatataggaatcaaggattttcttttgctttgtggccggattttgctactgcttgctcttcttactttaattatttctgtgactacctcatggcttaactcatttaaatctccccaagtttatctgaaggaagaagaagaaaagaatgagaaaagacaaaaacttgtgagaaaaaaacaacaagaagcacaaggagagaaggccagcagatacatagagaatgttttaaaacctcaccaggaaatgaaattgagaaaactggaggagcgcttttatcaaatgacgggtgaagcctggaaattaagcagtggtcacaaacttgggggtgatgaaggtacaagtcagacatcttttgaaacatcaaacagagaagcagcaaagagccagaacttgcctaaacctttaactgaatttccgtctcctgctgaacagcccacatgcaaggagattcctgatttacctgaagaaccttctcaaacagcagaagaagtagttactgttgctctccgatgtcccagtgggaatgtcctgaggagaaggtttttgaagtcctacagctcacaggtcttatttgactggatgacgagaattgggtaccacatatctctatacagcctttctacttcctttcccagacggcctctggcagtggagggaggccagtcgctggaggacataggaataactgtggacactgtactcatcctggaggagaaggagcagaccaactaggaaagaagggagagctccctgtttgcatgaagtcagttatgctatgaccttctggcacaataaaggcttcactttcgaatcacaccataccttgattgagctcatggcagtaaactttgaacattgatatccatgggaataggattagaaaaggattgctttctatatataataatctgtggactgtgccattttacagtgtacccaaatgagaatgaggttgaaatgtatgcagtaaggtactcagtaattaattggtattttttcccagctgacatgatttcctcagtgttagaaaacaaacccttagaactttcctttctgcctcttcaatccatcttaccacacaatatttcatgattcaaattcttcaaagtcttatacgcaggaatgtttattctgctgtatttctgtgaaattaaaaacttggaagaagcttcaaagctcttggaggctttaaagttctttctgttgggtgtgcattacagtttacttaactgatgtttgcgatttatataattttgccttgtattaaatgttacaaagttccaaatgaatcagtattttaaaaaataaaactatgaaagcattaaaatataggtgaatttttaaaaaaaaaaaaaaaaaaaaaaaaaaaaaaccaaaggggggggg

SEQ ID NO: 523 - DNA, 1541 bp, Homo sapiens
ccgagccccagcccggccgccatggacgacaaggcgttcaccaaggagctggaccagtgggtcgagcagctgaacgagtgtaagcagctgaacgagaaccaagtgcggacgctgtgcgagaaggcaaaggaaattttaacaaaagaatcaaatgtgcaagaggttcgttgccctgttactgtctgtggagatgtgcatggtcaatttcatgatcttatggaactctttagaattggtggaaaatcaccggatacaaactacttattcatgggtgactatgtagacagaggatattattcagtggagactgtgactcttcttgtagcattaaaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacagatattctgcctccatggtggcctctctccatccatagacacactggatcatataagagccctggatcgtttacaggaagttccacatgagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggagggatacaattggtgtcatgatcggaatgtggttaccattttcagtgcacccaattactgttatcgttgtgggaaccaggctgctatcatggaattagatgacactttaaaatattccttccttcaatttgacccggcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctagataggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtg

SEQ ID NO: 524 - DNA, 1651 bp, Homo sapiens
acggcacgaggagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggcgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccatcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccaattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgattgattgttgctttttttccaattttgttgcatcatgttgaataatgctgttttatatgtagagtcttttaaaacattcacaccattcgtcatcactcctctgtcatatgcagttttgttttttgctcttttcaatgtgtgtgaggtgttttttgtttttgtttttgtttttttgccatgttatttatagtgttgctttccttgtgctttccttgtggttttcttggttggttattcagaaaagatgtgcagatatcacagaggcctatagccttttggtatctacttctacatccaatgtatgaattaagctgtaagataatgttgctttcttatcccagtgatcacctgccaaatgaataagacaacaaagagaagcagaagggcaagaagattatttactgacatatatctattacacttgggattgtgcttactgttgcataactattttttaaacggagtttagttttatattgctagtaaaaaaaaaaaaaaaaaa

SEQ ID NO: 525 - DNA, 2199 bp, Homo sapiens
gggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccaattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaagcatcttgggattgaatttatggaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgaaaaaaaaaaaaaaaa

SEQ ID NO: 526 - DNA, 2490 bp, Homo sapiens
gtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggcgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccatcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccaattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccaagccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaataaaaaaaaaaaaa

SEQ ID NO: 527 - DNA, 1715 bp, Homo sapiens
gcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggcgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccatcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccaattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaaaaaaaaaaaaaaa

SEQ ID NO: 528 - DNA, 1860 bp, Homo sapiens
gggacagcctctcctgccgccgctgctgctgccgccgccgccaccgccggctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggaaaaaaaaaaccc

SEQ ID NO: 529 - DNA, 1793 bp, Homo sapiens
tcgctctccccatcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaagacataaccttatagctgagctaaggagaaacaaggcacacagatccaaatgcatgcagatccagctatcagcaactcatcttagatcttcttccattccccatttgggcttcattctctaagaccccttggcctttaggaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccacgcgcccacgcgtccgcggacgcgtgg

SEQ ID NO: 530 - DNA, 1199 bp, Homo sapiens
gcgcggaggccaggagctgagcggcggcggctgccggacgatgggagcgtgagcaggacggtgataacctctccccgatcgggttgcgagggcgccgggcagaggccaggacgcgagccgccagcggcgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccatcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccaga

SEQ ID NO: 531 - DNA, 1986 bp, Homo sapiens
gaattcctttttttttttttttttttctttttttttttgcccttatacctcttcgcctttctgtggttccatccacttcttccccctcctcctcccataaacaactctcctacccctgcacccccaataaataaataaaaggaggagggcaaggggggaggaggaggagtggtgctgcgaggggaaggaaaagggaggcagcgcgagaagagccgggcagagtccgaaccgacagccagaagcccgcacgcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcgccttgcctccccaattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaagg

SEQ ID NO: 532 - DNA, 2224 bp, Homo sapiens
gcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgaaaaaaaaaaaaaaaa

SEQ ID NO: 533 - DNA, 3549 bp, Homo sapiens
cggacaccatgcagtcggatgatgttatctgggatacactaggaaacaagcaattttgttccttcaaaataagaaccaagactcagagcttctgccgaaatgaatatagcctgactggactgtgtaatcggtcatcctgtcccctggcaaatagtcagtatgccactattaaagaagagaaaggacagtgctacttgtatatgaaggttatagaacgagcggcttttcctcggcgtctctgggaacgggtccggcttagtaaaaactatgagaaagcactggagcaaatagatgaaaatctgatttactggccccgtttcattcgacacaaatgtaagcagagattcaccaagatcacccaatacctaattcgaattagaaaacttacactaaagcgacagaggaaacttgttcctttgagtaagaaggtggagcgtagggagaaaagaagagaggaaaaggcattaatagctgctcagctggacaatgccattgagaaggaattactggagagactgaaacaagatacgtatggcgacatctacaacttccccattcatgccttcgacaaagccctggaacaacaggaggcagagagtgactcttcagatactgaggaaaaagatgatgatgatgatgatgaggaagatgtggggaaaagagaatttgtcgaagatggtgaggtagatgagagtgacataagtgattttgaggatatggataaactggatgccagcagtgatgaagatcaggatggtaaatcctccagtgaggaggaggaagaaaaggcccttagtgcgaaacacaaaggcaaaatgcccttgagaggaccactgcagagaaaacgagcctatgtggaaatagaatacgagcaggagacagagcccgtggccaaagccaaaaccacgtgatttccctttcagcatttatacccaggactgaacatgcagaactgtttttttttttttatcttaaacacatacacacctccagtttttgctcttttgtgttgtactgaacacaatatttgtgtttttattatttatgccacgtcagtggggcaagaaatctggagtgagtgaagaaagctaagttgtgaacaagagtgtttttatagcatatgtgttgaagtaacagcttgtgcccgagaaacttaacagatgagttcttgaatctgggatgagatgacggatgtaaatatttctaaattttaaatgctacattacttggtgtccttttttctcccaaactttatttagaaatggaaggagttcaattttttcttgttctactttccctattcttatggaggtaaaaggaaaggaaggaaggaaaaagcagctttcacttacaaagtttcgtgtaaaaatatctttttttcttaaataactccattcatacaaattgggatgggaagaaaatcctttcctcttgggaaagtaatacaagtcttaagttccattgtagggtgcgccttcagaaacctgctgcacttttctgatatagttcaccacttttctgtcttcacagctttggggaattttggccaggagaccctgaaacatgaaaccaaacaggctttgatattttttttttaattactttccccttttgcttgattcttcttccttggtatcatattcaaaggaggaaagaatggatgacacttagggacaggtcactaagcagaataggtattagttggttttttattatttttaaatttatatagctctcatgtattgaaggtgctactttaaaaactgtgttaatgtacttgcaaatctcctgctggctcatgaaacagcagaattccagccaaggcaaattcagttggatctagggcttgaaaactgcccaagattaaagagctaagatgaaatagtttgaataaactggtaaaataacaattcatactatctctacatatttttaggatatgaatttttttttcctgctgggtagattgtccagtgacttatggcatgaatttcttttcatgctaccttcaatcttcaactaaagatttctaaaaggggtaagaaatgaggcagtagtttattaaatacatagaagtacacagctattatatgctgtggctttgagaagttaacttttgtggaatatgaaaccaaaggaagaatttccatgtagataaattaagaatagggaaaaacatctacctaaaagatggttgtccctaaaaaaactggaaacatctgaaatgctctatttatgttattattcctgggagcttatagcccattatttttactttttttttttaattcagaagactagaacagaacttaaattttacaaacttttgatcataatgcttttgcccatactgtctcgtccttagccccagtgacatgtgctgatcctcctgcctttagttctaaatggttctgaatagctttaaaagatgaataagaaaaaagatcaagctcttttgaggctagagggctcatatggagatctaaaaccctccatgttcatttccagacttggtcaggcacatacatagtaaattataatcaatcatgggaattacataaggataatgaggcccaactgaaaccaagtttcagtctgccttacctttacccgtccttgagaacagcggtccaggagaatcaggcagtctgtggcctcctgtagcagggcgctcttaacagactcaggtgtaaggtttggatcccttgctacatcacaaatcagtttcaagagggccttcagtaagaccacaagtctgcaggaaactctggaatcaggaagaaaagctatgttcatactctaaatctggatattaaaattggaagagacttcaaagactgtcaagtggaaagctatcatttcctaaattaaggaacttaggtcaaagttaaatgaaaaagacctaaaaacagaaccaaagacagcctctagatttcttaccctcaagtctcctgttagcatactgcctatacacacagacacaccctctgccacactgctctcttccttccagaagcttggttctactgtaagcaacagctccttcatgggctgagaaggggaaaccaggatctccccaaccaagggcctatacttttatttttcaactctattaactgaactatgcttggagagagccctgaatcctttaactttaatgccatcttaggcctggaagttagagtgagggaaatgagcttggcttctgggactgtgtcaagttgaattttctgtcatttaatttcagatcctagctcatcatcagtgaagtccagcctacttacttgtaactattaacctttctaaaagttttcatcgccttggtaaagctccagaaatggacaatgctagtgactgcacaatattgtgactgtacttaatgccactgaactgtacactttaaaatggaaaatttatatgtatttttaccacaataaacaaaaaaccctaaaaaaactttaatgaaaggtggaaaataatttaacttacaatgtgaaaatacaatgtgaaatgtacaataaatcatatttatggaaaaaaaaaaaaaaa

SEQ ID NO: 534 - DNA, 2192 bp, Homo sapiens
ctttaaatttttaagttttttttctttttagtcttcagaaaggcaacagtagtcttttaacgtcactgttaaaagtgtaagactcttttactccctgagagtcccctttccctttcttgcgtcctttcctctttattctttttttttttttttttttttttactgagacggagtctcactctgtcgcccaggctggagtgcagtggcgcgatctcggctcactgcaaactccgcctcccgggttcaccctttctctttattcttatcccggtcagactcgccccctcctccaagacatctctctgttttattttatttgattttagttctctttgggtgatcgctccttccctcttcagcggatccctccccgcctccatcctcgttctgtgggagagaccagccttctggtgctgcagtcaggaatggagcttgacagcgctctggaagccccatcgcaggaagactctaatttgtccgaggagttgtctcactccgcctttggacaggccttctccaagattttacactgtcttgcccgcccggaggcacgacgaggcaacgtaaaagatgcagttcttaaagacctcggtgatctaatagaagccacaggatttgataggttatttgaggggactggtgcacggctccgcggaatgccggagacactggggcaggtagcaaaagccctggagaagtatgcagccccctccaaggaggaggaaggtggaggtgatgggcactccgaagcggccgagaaagcagcccaagttgggttactgtttcttaaactgttagggaaagttgagactgctaagaattccctggtcggccctgcatggcagacgggcctgcatcacttggcaggacccgtttatatttttgccatcacacacagcttggagcaaccatggaccactccgagatctcgggaagttgctagggaggtgctcacctcactgcttcaagttactgaatgcggttctgtggcaggattcctacatggagaaaatgaagatgagaaagggagactttcggtgatactagggcttctcaaacccgacttgtataaggaatcctggaagaataaccctgccatcaaacatgttttctcatggactctgcaacaggtcactcggccctggctgagccagcatctggaaagggtacttcccgcatcattggtcatttcagatgactatcagactgagaacaaaatcctgggtgtacactgtctccatcacattgtgcttaatgtgccagctgctgatttgctccagtataacagagcccaggtcctataccatgccatttccaaccacctgtacacaccagagcaccacctcattcaggctgtgctcctgtgtctgctggatttattccccatcctggagaaaaccctgcactggaaaggagatggagctcgacccaccacccattgtgatgaggtcctgcggctgatcctgacccacatggagccagagcaccgccttcttttacgcaggacctacgcaagaaacctgccggctttcgtgaacaggttggggatcctaactgtccggcacttaaagaggctggagagagtcatcattggttatctggaggtttatgatggacctgaggaggaagctagactgaagatattggaaaccctaaaacttctcatgcaacatacttggcccagagtttcctgcagacttgtggtcttactgaaggccctcttgaaactgatttgtgatgtagcaagggatccaaaccttacacctgagtctgttaagagcgccctgctacaggaggccacagactgcctgattctcctggaccgccgttctcaaggacgggtaaagggtctcctggccaaaattccccaaagctgtgaagacagaaaagtggtgaactatatcagaaaagtgcagcaggtttctgaaggcgcaccctacaatggaacttaagacttgtattactttcccaagaggaaaggattttcttcccatcccaatttgtatgaatggagttatttaagaaaaaaagatatttttacacgaaactttgtaagtgaaagctgctttttccttccttctttccttttacctccataagaatagggaaagtagaacaagaaaaaattgaactccttccatttctaaataaagtttgggagaaaaaaggaaaaaaaaaaaaaaaaaaaaaaa

SEQ ID NO: 535 - DNA, 2309 bp, Homo sapiens
ccggaaggaagtcgcgtgctgaggggtgtgacggttttcttgctcgtgggctcggacgagtacggagcgcctgcagggacagcctggataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttgatcagattgatgaaaatctcaaactggctttgcaacaggacctgacctccatggcccctgggctggtcattcaagctgtgcgggtaacaaagcccaacataccagaggcaatccgcagaaactacgagttgatggaaagtgagaagacaaagcttctcattgccgcccagaaacagaaggtggtggaaaaggaagcagagacagagcggaagaaggcgctcattgaggcagaaaaagtggcccaggtggctgagatcacctacgggcagaaggtgatggagaaggagactgagaagaagatttcagaaattgaagatgctgcatttctggcccgggagaaggcaaaggcagatgctgagtgctacactgctatgaaaatagccgaagccaataagctgaagctaacccctgaatatctgcagctgatgaagtacaaggccattgcttccaacagcaagatttactttggcaaagacattcctaacatgttcatggactctgcgggcagtgtgagcaagcagtttgaggggctagctgacaagctaagctttggcttagaagatgaacccttggagacggccactaaggagaattgaaaaaaacttgatatgactgcaaatgatacttaagcagatctttattttttaagatgaatcagaatgttcctccctccccgactaccttctctgactgtcttccagttactgtggtgaaaaagaagaaatgaacttaaatccactccctttctagggaaaggagggtggggactgatgatggggggttttatttcaggtaagcagtttatatgacttccaataagatttgtaaatcatgggcttgacctttgacctctagacactaattttatcctttgaggctggcttaattagggatgctgtcattaaggagagggagaaatgtagagtgttacctccaactcatttgatttcccttacttgggaaaatgcagtccagtgttctcacctctgcctccaaggtaggagatgtctgtgggtgaggctcagcaactgagcaaatatgtgcctgtgagtttgccagtagagctgtgaagaaacagctgcagagaacatttgaccttcctggcattcttgtctgcatgtgtgtgagttattttagaggtgtgctttcttgagccctcataaggaagtactggtgctaggttttgcaagattttgtatacactttgctccttgccctagggctcagagtggtggtttctgactacatttctagagtcagagcttgatcaccacaactcaattatttcggcatcttttcacctatgctgtgatttgttttttttttttcttctcaaaaattctgttcattggttccactcagcatcaagaagacagggacaaacaactcaagtgtcttaacagctgctggagtgggatccttgttatctcttagccactgcaggacctgcctgacaggttatgtgtgcacctcgagatgaagtgtctttctattattgtagagattctgtagtgaagaggtctgacaccatgtgtggaggaggaggaacgatcagtcaagagatgtcctggtcttaatgcctgtggcttgtgctgggagtgggtctgacttagtgataaaaggactctattcactaagtagcctgtgtttttaaatccagggctgcaggcagcaacgcaagtcaggctgaacattcagtctccagagacagctgtgtggagcaaatcagagttcatgcccaagtccccaggttggaatggctgtgccaaaatccattcaaaggg

SEQ ID NO: 536 - DNA, 2309 bp, Homo sapiens; identical to SEQ ID NO: 535

SEQ ID NO: 537 - DNA, 3012 bp, Homo sapiens
gaagaaagaagagtttcctttcgtatcgcttaggggttcctcgcaagaaccatctgacagagaaaagccctggctcccgccccagtggcttctaattctggtccccgcgcccagaaagccgggaacgggcaagcctggaaaggcgttttgaaaggaaacaggatcccccgagtataggatgcgtttctgcctcacaaaagtcccttgggggtggggggacggcagcggctgaggcgcaggaaagaggagagcacacggggagtggcccttggaaccaggcgcgcaaaacctcagcccctaggctccatttccaggttcgcgggtgacctccccaagatggccgccgcctgggggcgggcctccacgctgcacgggtgttgattgggtgagacgactcaatggtgagcaatgattggttcacacggcgcaagctgggcggaaccggaagatggtgtgagccacgggctgccgggggcctggggctcggcgtcggtccccgggggatgtggagagctggcagcatgtcggccgagctgggagtcgggtgcgcattgcgggcggtgaacgagcgcgtgcagcaggctgtggcgcggcggccgcgggatctcccagccatccagccccggctagtggcggtcagcaaaaccaaacctgcagacatggtgatcgaggcctatggacatgggcagcgcacttttggcgagaactacgttcaggaactgctagaaaaagcatcaaatcccaaaattctgtctttgtgtcctgagatcaaatggcacttcattggccacctacagaaacaaaatgtcaacaaattgatggctgtccccaatctcttcatgctggaaacagtggattctgtgaagttggcagacaaagtgaacagttcctggcagagaaaaggttctcctgaaaggttaaaggttatggtccagattaacaccagcggagaagagagtaaacatggccttccaccttcagagaccatagccatcgtggagcacataaacgccaagtgtcctaacctggagtttgtggggctgatgaccataggaagctttgggcatgatcttagtcaaggaccaaatccagacttccagctgttattgtccctccgggaggagctgtgtaaaaagctgaacatccctgctgaccaggttgagctgagcatgggcatgtccgcggatttccagcatgcggttgaagtaggatctacaaatgtccgaataggaagcacgatttttggagagcgggattactcaaagaaacccaccccggacaagtgcgcagcagacgtgaaggccccgctggaggtggcacaggagcactgagccagggaatactgagagcactaactatgcactaacctagattttcatttcgatattccctgtgtcccagcgcagtcctgctctcctgtgacctgtggagagcactaatgatcacgtgtgttgatggaaaccatctgtgcttagtctctgacataggaagcttgcttcaggcaatggctttggattgagtttgagaaattcaaacatttctgcagaacagataccaaatcaatagctaggaatcatgttcaatattgaattctgcccaggagcatgaactgatccatgaatgccttttccaggttaaaatttggtcactgatgcctataatcgtggaagtcagagggattcccctttttcatctcattttaataggaaaattccttatggttaacatctccctacaaactcctactacgtcgtctaaattgctgctctggaataaggtgatttctgcccccagattcttccctagccggtagatacgtgaagatattcccaactgtggaatggcagtgtaggtagcttcaggaaatggctcaggttaattctcaaaacacaaattgttgctggccaggcatggtgactcatgcctgtaatcccagcaatttgggagacagaggcggaaggatcacctgagcctaggagttcaagaccagcctcagcaacagcaggagccccaccccccgtctctacaaaaaaatttaaaaattaactgggcatggtggctgaggtggaagaatggaagaatcacttgagcccaggagtttgaggctgcagtgagctatgattgcaccactgtactcctgccttaaaaaaaaaaaaaaaatcccaatagtccatgaaggctttgatctcttgggaagttcttcatagatgctgtcacatttcttaaagcaaccttttaatatgcagataataccccccaacttttttagagacagcctgtctcttaaaaaaaaaattaatttggtagtgagagcttgtgtcactgccactctgttttatccctgaaattaaaggataacataaggaggacttgggcctttctgacatcatcctgaagagacaggactttgcgtttttcctctgggacctacagtgatgagaatttaatgattatctcctccactataatcctctttagggtgattttttaaatcaaaacccagtgaatctcattactcctaagaaacgaaagattccttcaaagccttttcaggcacatggtttcaacaaagcctggctttgacattccttgtcctgaggagcactttccaggcatagttacagcttccccactgtatttacaagccagaattgtgcaactcttctggatcattaataaagtagcaagatcctcaaaaaacccaaaaacaccattctctaatagtcatgacaaatggcttcagtatggcttgttttttattttccagatggctttttctcttattttttgaagccccagtctttgattttacaggtaactttcaaaacatcatgatgctgccaaatgtacttttgtaaacttaaacattatgattcctgtattatttcagtgagagctacagtgtgatatttcagagtctattaaataaaaatgtgagtttgaattacaccatctgtgccaattacaaagcaattaaaagatttattttttatgaaaaaaaaaaaaaaaaaa

SEQ ID NO: 538 - DNA, 5830 bp, Homo sapiens
tttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 539 - DNA, 5776 bp, Homo sapiens
tttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 540 - DNA, 3656 bp, Homo sapiens
ctctgcgggccgcgggtgcgggtcgtcgctaccggctctctccgttctgtgctctcttctgctctcggctccccaccccctctcccttccctcctctccccttgcctcccctcctctgcagcgcctgcattattttctgcccgcagctcggcttgcactgctgctgcagcccggggaggtggctgggtgggtggggaggagactgtgcaagttgtaggggagggggtgccctcttcttccccgctcccttccccagccaagtggttcccctccttctccccctttcccctcccagcccccaccttcttcctctttcggaagggctggtaacttgtcgtgcggagcgaacggcggcggcggcggcggcggcggcaccatccaggcgggcaccatgggcacgtccgcgctctgggccgtctggctgctgctcgcgctgtgctgggcgccccgggagagcggcgccaccggaaccgggagaaaagccaaatgtgaaccctcccaattccagtgcacaaatggtcgctgtattacgctgttgtggaaatgtgatggggatgaagactgtgttgacggcagtgatgaaaagaactgtgtaaagaagacgtgtgctgaatctgacttcgtgtgcaacaatggccagtgtgttcccagccgatggaagtgtgatggagatcctgactgcgaagatggttcagatgaaagcccagaacagtgccatatgagaacatgccgcatacatgaaatcagctgtggcgcccattctactcagtgtatcccagtgtcctggagatgtgatggtgaaaatgattgtgacagtggagaagatgaagaaaactgtggcaatataacatgtagtcccgacgagttcacctgctccagtggccgctgcatctccaggaactttgtatgcaatggccaggatgactgcagcgatggcagtgatgagctggactgtgccccgccaacctgtggcgcccatgagttccagtgcagcacctcctcctgcatccccatcagctgggtatgcgacgatgatgcagactgctccgaccaatctgatgagtccctggagcagtgtggccgtcagccagtcatacacaccaagtgtccagccagcgaaatccagtgcggctctggcgagtgcatccataagaagtggcgatgtgatggggaccctgactgcaaggatggcagtgatgaggtcaactgtccctctcgaacttgccgacctgaccaatttgaatgtgaggatggcagctgcatccatggcagcaggcagtgtaatggtatccgagactgtgtcgatggttccgatgaagtcaactgcaaaaatgtcaatcagtgcttgggccctggaaaattcaagtgcagaagtggagaatgcatagatatcagcaaagtatgtaaccaggagcaggactgcagggactggagtgatgagcccctgaaagagtgtcatataaacgaatgcttggtaaataatggtggatgttctcatatctgcaaagacctagttataggctacgagtgtgactgtgcagctgggtttgaactgatagataggaaaacctgtggagatattgatgaatgccaaaatccaggaatctgcagtcaaatttgtatcaacttaaaaggcggttacaagtgtgaatgtagtcgtgcctatcaaatggatcttgctactggcgtgtgcaaggcagtaggcaaagagccaagtctgatcttcactaatcgaagagacatcaggaagattggcttagagaggaaagaatatatccaactagttgaacagctaagaaacactgtggctctcgatgctgacattgctgcccagaaactattctgggccgatctaagccaaaaggctatcttcagtgcctcaattgatgacaaggttggtagacatgttaaaatgatcgacaatgtctataatcctgcagccattgctgttgattgggtgtacaagaccatctactggactgatgcggcttctaagactatttcagtagctaccctagatggaaccaagaggaagttcctgtttaactctgacttgcgagagcctgcctccatagctgtggacccactgtctggctttgtttactggtcagactggggtgaaccagctaaaatagaaaaagcaggaatgaatggattcgatagacgtccactggtgacagcggatatccagtggcctaacggaattacacttgaccttataaaaagtcgcctctattggcttgattctaagttgcacatgttatccagcgtggacttgaatggccaagatcgtaggatagtactaaagtctctggagttcctagctcatcctcttgcactaacaatatttgaggatcgtgtctactggatagatggggaaaatgaagcagtctatggtgccaataaattcactggatcagagcatgccactctagtcaacaacctgaatgatgcccaagacatcattgtctatcatgaacttgtacagccatcaggtaaaaattggtgtgaagaagacatggagaatggaggatgtgaatacctatgcctgccagcaccacagattaatgatcactctccaaaatatacctgttcctgtcccagtgggtacaatgtagaggaaaatggccgagactgtcaaagtactgcaactactgtgacttacagtgagacaaaagatacgaacacaacagaaatttcagcaactagtggactagttcctggagggatcaatgtgaccacagcagtatcagaggtcagtgttcccccaaaagggacttctgccgcatgggccattcttcctctcttgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcaatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgctgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttggtacgtatgaatgatatctttgacctcaatggaggtttgcaaagactgagtgttcaaactactgtacattttttttcaagtgctaaaaaattaaaccaagcagcttaaaaaaaaaaaaaaaaaaaaaaaaaaaaaaa

SEQ ID NO: 541 - DNA, 2112 bp, Homo sapiens
ggaagttaaagggaaaaagcaattcacaggaaagagtacaaagacagcacaagaaaaaaacagatttcataaaaatagtgattctggttcttcaaagacatttccaacaaggaaagttgctaaagaaggtggacctaaagtcacatctaggaactttgagaaaagtatcacaaaacttgggaaaaagggtgtaaagcagttcaagaataagcagcaaggggacaaatcaccaaagaacaaattccagccggcaaataaattcaacaagaagagaaaattccagccagatggtagaagcgatgaatcagcagccaagaagcccaaatgggatgacttcaaaaagaagaagaaagaactgaagcaaagcagacaactcagtgataaaaccaactatgacattgttgttcgggcaaagcagatgtgggagattttaagaagaaaagactgtgacaaagaaaaaagagtaaagttaatgagtgatttgcagaagttgattcaagggaaaattaaaactattgcatttgcacacgattcaactcgtgtgatccagtgttacattcagtatggtaatgaagaacagagaaaacaggcttttgaagaattgcgagatgatttggttgagttaagtaaagccaaatattcgagaaatattgttaagaaatttctcatgtatggaagtaaaccacagattgcagagataatcagaagttttaaaggccacgtgaggaagatgctgcggcatgcggaagcatcagccatcgtggagtacgcatacaatgacaaagccattttggagcagaggaacatgctgacggaagagctctatgggaacacatttcagctttacaagtcagcagatcaccgaactctggacaaagtgttagaggtacagccagaaaaattagaacttattatggatgaaatgaaacagattctaactccaatggcccaaaaggaagctgtgattaagcactcattggtgcataaagtattcttggacttttttacctatgcaccccccaaactcagatcagaaatgattgaagccatccgcgaagcggtggtctacctggcacacacacacgatggcgccagagtggccatgcactgcctgtggcatggcacgcccaaggacaggaaagtgattgtgaaaacaatgaagacttatgttgaaaaggtggctaatggccaatactcccatttggttttactggcggcatttgattgtattgatgatactaagcttgtgaagcagataatcatatcagaaattatcagttcattgcctagcatagtaaatgacaaatatggaaggaaggtcctattgtacttactaagccccagagatcctgcacatacagtacgagaaatcattgaagttctgcaaaaaggagatggaaatgcacacagtaagaaagatacagaggtccgcagacgggagctcctagaatccatttctccagctttgttaagctacctgcaagaacacgcccaagaagtggtgctagataagtctgcgtgtgtgttggtgtctgacattctgggatctgccactggagacgttcagcctaccatgaatgccatcgccagcttggcagcaacaggactgcatcctggtggcaaggacggagagcttcacattgcagaacatcctgcaggacatctagttctgaagtggttaatagagcaagataaaaagatgaaagaaaatgggagagaaggttgttttgcaaaaacacttgtagagcatgttggtatgaagaacctgaagtcctgggctagtgtaaatcgaggtgccattattctttctagcctcctccagagttgtgacctggaagttgcaaacaaagtcaaagctgcactgaaaagcttgattcctacactggaaaaaaccaaaagcaccagcaaaggaatagaaattctacttgaaaaactgagcacataggtggaaagagttaagagcaagatggaatgattttttctgttctctgttctgtttcccaatgcagaaaagaaggggtagggtccaccatactggtaattggggtactctgtatatgtgtttcttctttgtatacgaatctatttatataaattgtttttttaaatggt

SEQ ID NO: 542 - DNA, 927 bp, Homo sapiens
ggcagcgggcgaaaggagccggggcctggaggtttgcgtaccggtcgcctggtcccggcaccagcgccgcccagtgtggtttcccataaggaagctcttcttcctgcttggcttccacctttaacccttccacctgggagcgtcctctaacacattcagactacaagtccagacccaggagagcaaggcccagaaagaggtcaaaatggggtttatattttcaaaatctatgaatgaaagcatgaaaaatcaaaaggagttcatgcttatgaatgctcgacttcagctggaaaggcagctcatcatgcagagtgaaatgagggaaagacaaatggccatgcggattgcgtggtctcgggaattcctcaaatattttggaactttttttggccttgcagccatctctttaacagctggagcgattaaaaaaaagaagccagccttcctggtcccgattgttccattaagctttatcctcacctaccagtatgacttgggctatggaacccttttagaaagaatgaaaggtgaagctgaggacatactggaaacagaaaagagtaaattgcagctgccaagaggaatgatcacttttgaaagcattgaaaaagccagaaaggaacagagtagattcttcatagacaaatgaaatcatgcttaccaatcaaatctcaaagcacagaattattgacttgaatcatggtttttacagttttttaaatgctcaagattttgatattatagattttattttaaaatattaaaatgcaagatagttttgagctattttaaaataaaatttataacattcaacacaaaatcatggaggtgctctaaataacttttagatttcctctctctgtgtgcattaccaatatctaagtgtaaaattaataaattgttttgaattcctggaaaaaaaaaaaa

SEQ ID NO: 543 - DNA, 1518 bp, Homo sapiens
acgcggggtttttcttctcttgaatatatcttaacgccaaattttgagtgctttttttgttacccatcctcatatgtcccagctagaaagaatcctgggttggagctactgcatgttgattgttttgtttttccttttggctgttcattttggtggctactataaggaaatctaacacaaacagcaactgttttttgttgtttacttttgcatctttacttgtggagctgtggcaagtcctcatatcaaatacagaacatgatcttcctcctgctaatgttgagcctggaattgcagcttcaccagatagcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaacttggctgcttcacattttcatcccctcctgcatcattgctttcattttcatagccacagtgatagccctaagaaaacaactctgtcaaaagctgtattcttcaaaagacacaacaaaaagacctgtcaccacaacaaagagggaagtgaacagtgctatctgaacctgtggtcttgggagccagggtgacctgatatgacatctaaagaagcttctggactctgaacaagaattcggtggcctgcagagcttgccatttgcacttttcaaatgcctttggatgacccagcactttaatctgaaacctgcaacaagactagccaacacctggccatgaaacttgccccttcactgatctggactcacctctggagcctatggctttaagcaagcactactgcactttacagaattaccccactggatcctggacccacagaattccttcaggatccttcttgctgccagactgaaagcaaaaggaattatttcccctcaagttttctaagtgatttccaaaagcagaggtgtgtggaaatttccagtaacagaaacagatgggttgcaatagagttattttttatctatagcttcctctggg

SEQ ID NO: 544 - DNA, 4615 bp, Homo sapiens
ggacagagcgcaatggcggcaaccgcgtctgcaggggtgccggcgaccgtgtcagaaaagcaagagttttaccagcttctgaagaacctgatcaatccaagctgtatggtgcggaggcaagcagaggaaatctatgaaaatatcccaggtctgtgtaagactaccttcctcttagatgccgtcagaaatagaagagcaggttatgaggtgagacaaatggctgccgcactgctacgacggcttttgtcctctgggtttgaggaggtttatccaaatctgcctgctgatgttcagagagatgtcaagattgaactgattctggctgttaagttagaaacacatgctagcatgaggaaaaaactttgtgatatttttgcagtgctggccaggaatttgatagatgaggatggcactaaccactggccggaaggtctgaagtttcttattgattcaatctactccaaaaatgtggttctatgggaagttgcacttcacgttttctggcactttcctgggatttttgggactcaagagcggcatgatttggatatcatcaaacggttgttggaccagtgtattcaagatcaagaacatccagcaatcaggacattatccgctagagctgcagctgcatttgtacttgctaatgagaataatattgctcttttcaaagactttgcagacttgcttcctggaatcttacaggctgtgaatgactcatgctaccaggatgatgattcagtgctagaatcccttgttgagattgcagataccgtacctaagtacttgggtccttatttagaagatactctacagttgagtttgaagttatgtggagactctaggcttagtaatctgcagcgccagctggccctcgaagttatagtgaccttgtctgaaactgccactccgatgttgaaaaaacatacaaatattattgcacaggcagttcctcatatattagcaatgatggttgatctacaagatgatgaggactgggtaaatgctgatgaaatggaagaagatgattttgacagcaatgcagttgctgcggagagtgcactagacagactggcttgtgggcttggtggaaaagttgttttaccaatgaccaaggagcatatcatgcagatgcttcagagccctgactggaagtatcgacatgctggattaatggccttatctgccattggagaaggatgccatcaacaaatggaatcaattctagatgaaacagttaactccgttttgctttttcttcaggatcctcatccaagggtgagggctgcagcctgtactacacttggacagatggctacagattttgcacctaatttccaaaagaaatttcatgaaacagtgattgcagctctgttacgtaccatggaaaatcaaggtaatcagcgtgtgcaatcacatgcagcttctgctcttattatttttattgaagactgccctaaatcattgctagttctatatgtggatagtatggtgaaaaatctacattccgtcttggtgattaaacttcaagagttgattcggaatggaactaagttggctttggaacaacttgtgacaaccattgcatcagttgcagatacaatagaagaaaaatttgtcccatattatgatatattcatgccctcactaaagcacattgttgagcttgctgttcagaaggaactcaagcttctgagaggaaaaactatcgagtgcattagccatattggtcttgctgttgggaaggaaaaatttatgcaagatgcatcaaatgtgatgcagctgttgttgaagacacaatcagacttaaataatatggaagatgatgaccctcagacctcttacatggtttcagcatgggctagaatgtgtaaaattcttggaaaagattttcaacagtaccttccactggttatcgagcctcttattaagactgcttcagccaaacctgatgttgctctcttagacacacaggatgtggaaaatatgagtgacgatgatggctggcaatttgtaaatcttggagaccagcagagttttggaattaaaacttcaggacttgaagcaaaagcaactgcttgccaaatgttggtttactatgctaaggagttaagggaagggtttgtggaatatacagaacaagttgtgaagctgatggttcctttactgaaattttatttccatgacaatgttcgagtggcagcagcagagtccatgccttttctcctggaatgtgcaagaattcgtggcccagagtatcttgcacagatgtggcaattcatatgtgaccccttaatcaaggctattggtactgaaccagatacagatgtgctctcagaaataatgaattcttttgcaaagtccattgaagttatgggagatggttgccttaatgatgaacacttggaagaactgggaggaatactgaaagcaaaacttgaagggcactttaaaaaccaagaattgagacaggtgaaaagacaggaagaaaactatgatcaacaggttgagatgtctctgcaagatgaggatgaatgtgatgtttatattctgaccaaagtatcagatattttgcactcattatttagtacttataaggaaaagattttaccatggtttgaacaactacttccattaattgtaaatctaatttgttcaagtaggccatggccagacagacagtggggattgtgcatatttgatgacatcatagagcactgcagtccaacttcatttaaatatgtagaatattttcggtggccaatgctactaaatatgcgagataacaaccctgaagtcaggcaagctgctgcttatggcctgggtgtcatggcacagtttggtggagatgattatcgttctttatgttcagaagctgttccacttctggtaaaagttattaagtgtgcaaattccaaaaccaaaaaaaatgtcattgctacagagaactgtatctcagcaatagggaagattttgaagtttaagcctaactgtgtaaatgtagatgaagttcttccacactggttatcatggcttccactgcatgaagataaagaggaagctattcagactttgagttttctctgtgacctaattgaaagtaaccacccagttgtaattggtccaaataattccaatcttcccaaaataatcagtataattgcagaaggaaaaattaatgagactattaactatgaggatccttgtgccaaacgcctagctaatgtcgtgcgtcaggtacagacttctgaagatttatggttggaatgtgtatcacaacttgatgatgaacagcaggaagccttacaggagttgctaaattttgcttgaagcactttaatataacttgaatattatctattataaaagtaactacaaataagtgttgtgaatagattttattataaatcagagaactgttttctccctgctaagcagtttatagttcttctccatgtttctccagaattaatcagtgttagtcctctgtttatctcgcatgttttatcttccaaacacagaccttggtgataacctgtgcttcaaactgtcttaaacaatgtttgtcacctttcccctagttgatgtaaagtatataaattgttgctatttgtttgaactattattgatgctagccaagcagtatacttgatgtgaagatgtcatgctatcacaatatgctaagagctcacaaaaataagatagaatttccaggacaaacatctttggaattgtgagtgaaggatatagtggcaggcttgtccctctttaattaatactcttggtatttgtggtgatgggaggatgctgttactaggagagttttgagatactgcagtggatgtgggatgtatatgaacttcttcataatgtactcctgggaactgggtaggacatatccatattgtagttcccaaggtgtctggttgagagttagagaacttttaaatttctttagccagacaggtctctatttttttaagttatccaggactccaagaaccatagttactgaaaagggagtcctgatacatctaatattggtagcatgtaacagtgtttgacaaagagtaagtaagcagtattcttgggagtcagtgttatgtgtttcagcagagtattattttgtatatgtatgccattttctccctgcaaagcagctcaacaagagaaaaagctctagttatagggcttaaattgatttctatttcaaataatttcctaagagattctagagtagaactgaagagtattctattggaaaagtgaaaggaaagaaatgtaattttctttgaacatgaaaaagaaaacaactttgagagtagtcatttagcagtagatgtgcattattatgagaaaacagttctataagtccagggttaattatattaattggaatgtcagtctttaatgtcgagcttattgtagggtagaaaagagctttctactcagctaacgattactcattgatccaaaacttaaatacatctataatttcctggggctattgtgagtactgtgtatgtatttagcaaatatttaagacctagtaagtgctcaataaattgtagctgttattgctgttgttgtttgtaaaaaaaaaaaaaaaaaaaaa

SEQ ID NO: 545 - DNA, 2424 bp, Homo sapiens
cctggaactctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatggaagcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagaygaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaggaaaagaggaagactggacaaaacaacacaaaggcagaaaggaaagaaactgaagaaagaagataatagaccagcaattgcagcacttacaatcactaattcccttaaggttaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagagatgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagagggcaagtgcaatttattaaatttatattcttaaagggggaattcatggattattaaggtccttcaggcccttggggactctta

SEQ ID NO: 546 - DNA, 2424 bp, Homo sapiens; identical to SEQ ID NO: 545

SEQ ID NO: 547 - DNA, 2533 bp, Homo sapiens
gtggggcgaacatggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccggggacttgtcgctgagggagccgccggcatccgctctgcctgggagccaggcagctgactccgaccgggaggatgccgcggtggccagggatctggactgcagcctggaggcggcggctgagctgagggcggtgtgcggccttgataaactgaaatgccttgaggacggtgaggatccagaagtcattccggagaatactgacctggtgactttgggggttagaaaaaggttcttggaacatcgggaagaaaccattacaatagatcgagcctgcagacaagaaacattcgtttatgagatggagtcacatgccataggaaaaaagcctgaaaattcagcagacatgattgaagaaggggagcttatcctatctgtgaatatcttgtaccctgttatatttcataagcacaaagaacacaaaccataccaaacaatgctggtgttgggcagtcaaaaactcacacaactgagggattcaattcgatgtgtcagtgacctccagattggtggtgaattcagcaacactcctgaccaagcccctgagcacatcagcaaagacctatacaaatcagccttcttttattttgaaggaacattttataatgataaaagatacccagaatgcagagatttgagcagaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataaggcttgtgcatcatgatgactgcttggataggacattgtatcccctccttatcaagaagcattggctatggaccagaaaatgttttgtttgtaaaatgtatacagccagatgggtgacgaacaatgacagttttgcaccagaggacccatgcttcttttgtgatgtttgcttccgaatgctgcactatgattcagaaggcaacaaactgggggaattccttgcttatccttatgttgatcctggaacctttaattaagaatagctacactcacaaaaataccccctcatgaaataactgttctcttggatggttaccttatttctaagaaacgccactgaggaacaggatccactttgaacagtccgctaaagctatcaaaaaaaagtccaaatcacagattttcttataatgatagtatttaaatgtttataacatagtttaattttatatttattccagatagtatttaatttagtgctttttacccattttgagttgagttgtagtactttatatattctgactttaaatcctttgctcagacacacatattctttctcccaatccatgccttccctattcattctctgtccagagttttttgctaaagatagaattattaatgatacatcaagtagtggaagtgttttgaaaattctttgaagaatgtgagagctacaccttctaccatgaggcttccaaggttgtatttaaatttgactgaatatctggatggctaagaacagacatttatcttacacatggaaaactgacgaaacctataagcctatgtgtttgacagtgaagtatgttttatggacttaaatgccacaaacagttaagtccattggcttggagatgacaagcacgagtttctggtatgtctagtgttctcattcactgattcagtcagtacacagataatcactatagagaacttaagaggctggcttatgttatacctaaatttttactttctgtatacaacaatgctaaaattgagcagattgataactgccagcaaaccatagatttaagataaatgaatgatttacccaacccgaaattccatgggctaaattttgatcctttattttcaatacgcgttccttataggtcttacatcgatatcgaaggatattttatcttattcattcatttcatactctcaaaacaccaaacttcaaaaagttaattattgtcataatgcattattccatgtgtggtgtcaatacattttagcggacaaagaagaaacatgccagttaaaacatttctgctactggattctttattaattatttgagaacgttattttgctagttcttaaggttaagtttttcatcaaagactcaggtacctattattgttccctggtgaaactgaggagaaaagttaatcaaccaggttactcccacagtttgcccgtgtgttatgtatcagttatacaggtatcccaccaagttcaagtcaaaagaaattcctaactttgtatatttctggagctatataaacccctgatttaagaaaaaaaaaaaaaa

SEQ ID NO: 548 - DNA, 1677 bp, Homo sapiens
gaattcgcggccgccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagagggaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcaccaaacaacatgtaatctacagtaataaaaaatatatctcattttgggctcaaagcattaatccagttactgaaaagagaatacaagtggagcaaacaagagatgaagatcttgatacagactcattggactgaatttcccccttccccccatgatggaagaatgttcagattctaaattgaggacttcattattaatggcattactgtgttatgattaacaaatttcttgtaaggtacacactacatactaaggtcggccatcattccgtttttttttttttttttttttttaaccaagcttaaaatgaagcttaaaatgaagctttgtgtttgaaagtaataacaagctcagacgaagatggtggttgtacattattcatctagaaaatataaaaattcattttgttttgaagctagttattaaactggaatagcagttatatccctgagaatggggcccttctcttgacattccttttgttgtttaattctttagaatcttaataaatgtttttttaatcctgagagattaaacagtagtagacttgttaagaatgaaactgtaaccaaaattttaaaataaagttttttttaaaaaaaaaaaaaaaaaaaaaaaaaaaa

SEQ ID NO: 549 - DNA, 3377 bp, Homo sapiens
gggagccgcgcgggagcagcgcagctacggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcagcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccggaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggttttcatttgaaatagactgctggaagtttaaatttttataagcataggtttgatgttgaaaacttgttttgagggagaaaatccctttgttttaaagtaaagtaaacattatcgctaagtgtaacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacattgaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgtttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaaaaaaaaaaaaaaaaaaaaa

SEQ ID NO: 550 - DNA, 1598 bp, Homo sapiens
cggctccctcccggaaagcgagcgtatctcccgagccgttgccactgacagccgcgggcgctcccatctgagtaagagccagcccgtccgcggcctctccagccccgggttcgcgctctcgactctcctgcctgcccagctgcgcggcggagcggagcgaggcgcggcctgcgagtccccggcagcccccgacccctccctcggcgctgcgtgtaggccgcgccctcaggcccagtccgcggtgccccggcgggtgatgccaaatacagccatgaagaaaaaggtgctgctgatggggaagagcgggtcggggaagaccagcatgaggtcgataatcttcgccaattacattgctcgcgacacccggcgcctgggggccaccattgacgtggaacactcccacgtccgattcctagggaacctggtgctgaacctgtgggactgtggcggtcaggacaccttcatggaaaattacttcaccagccagcgagacaatatcttccgtaacgtggaagttttgatttacgtgtttgacgtggagagccgcgaactggaaaaggacatgcattattaccagtcgtgtctggaggccatcctccagaactctcctgacgccaaaatcttctgcctggtgcacaaaatggatctggttcaggaggatcagcgtgacctgatttttaaagagcgagaggaagacctgaggcgtctgtctcgcccgctggagtgtgcttgttttcgaacgtccatctgggatgagacgctctacaaagcctggtccagcatcgtctaccagctgattcccaacgttcagcagctggagatgaacctcaggaattttgcccaaatcattgaggccgatgaagttctgctgttcgaaagagctacattcttggttatttcccactaccagtgcaaagagcagcgcgacgtccaccggtttgagaagatcagcaacatcatcaaacagttcaagctgagctgcagtaaattggccgcttccttccagagcatggaagttaggaattccaacttcgctgctttcatcgacatcttcacctcaaatacgtacgtgatggtggtcatgtcagatccgtcgatcccttctgcggccactctgatcaacattcgcaatgcccggaaacactttgagaagctggagagagtggatggccccaagcacagtctccttatgcgttgaatattgccaaatgctctttctgaaaatgctgaattgccttttttgtttgcatcctttatttttaatattcataatgtcgtgtgcttaaaagtgggctttgaagtgtgtgctgcttactcctttcatctttctccccgcttccccagtctttaaacattggacgctatttactcagctacccagtagagcttgaagctgacctttctgagaagttggtatggtgtaacactaaagtaggtggttcgtgtgtgttctcattacctggttatgatagatatgcacatcaaagcctttaccagtatcttcctgtattccgtatcagattgcaaagacggaatgttactattttatcagcaaggtattaaaatgcatttataaattcaaaaaaaaaaaaaaaaaa

SEQ ID NO: 551 - DNA, 6334 bp, Homo sapiens
cttaagggcgggagtctcggtttgtggtggcttcgctgaggcagtggtggccgcactataccgttagaaactcaatttcccggaggttgtgaggccctttgaggcgaaatcgctctgggcgtgaaaggagcaggcgttggcaatggaaggaccaccgcgacctcaggctgaccgtagggagggatcttgagggccctccgagtcccctgggcttgcgctttctttctttgcagccaccgtgcctaccgcgaggatgagctcggcctcggtcaccgctttcgagaaggagcatctctggatgtatctgcaggcgctcggcttcgagccaggcccggcaaccattgcctgcggaaagatcgtgtcgcacacgcacctcggagtgaacatgtttgacaagctgaaccgtgatgcctttcatataatttcttattttttgtttcaagttctggaccagtctctcaccaaagaagttttcaaattttgttggcccccatttgaccaaaaaagtgacactgaattccgaaaacattgctgtgaatggataaaaaggatttctggtgaatgtggaagtagctttcctcaagttgttggttcactatttctttctcctggtggtcctaagtttattcatctgatgtatcattttgcaagatttgttgcaatgaaatatattaaatccaattctaaaaattcttctcatcattttgtagagacatttaacataaaaccacaggacttgcacaaatgcattgccagatgccatttcgcacgtagcagatttttacaaattttgcaaagacaagattgtgttacccaaaaatatcaggaaaatgcacaattatcagttaagcaggtacgaaacttgagatctgaatgtataggattggaaaaccaaataaagaaaatggaaccctatgatgaccacagtaatatggaagaaaaaattcaaaaggttcggtctttgtgggcttcagtgaatgaaacgctcatgtttttggaaaaagagagagaagttgttagttcggtccttagtcttgttaaccaatatgctttagatggaactaatgttgctattaatattccaaggctcttacttgacaaaattgagaaacaaatgtttcagttgcacataggaaatgtttatgaggctggaaaactgaacctcttaacagttattcagttattaaatgaagtcttgaaggtgatgaaatatgaacgttgtcaggctgatcaagcaagattgacggtagaccttcactaccttgaaaaagagaccaaatttcagaaggaaagattatcagatctgaaacatatgaggtatagaataaaagatgatctcacaactataagacattctgttgttgaaaagcaaggagaatggcataaaaagtggaaagaatttcttggtttgtctcctttcagtctaattaaaggttggactccatctgtagatcttttaccaccaatgtctccgctttcgtttgatcctgcctcagaagaagtgtatgcaaagagtattctttgtcagtatcctgcttcacttccagatgcacataagcaacataaccaagaaaatggttgcagaggagacagtgataccttgggagcgctacatgatctagccaacagccctgcctctttcttgtcgcagtcagtttcatcatcagatagaaacagtgttacagtacttgaaaaggacacaaagatgggaactcccaaagaaaaaaatgaagcaatttctaagaaaataccagaatttgaagtggaaaattctccattgtcagatgttgcaaagaatacagagagtagtgcatttggagggtctttgccagctaaaaaaagtgatccatttcaaaaagagcaagatcatctggtagaagaggttgccagagcagttttatctgattcaccacagctctctgaaggaaaagaaataaaattagaggaactaattgactctctgggttctaaccccttcttaacaaggaatcagattccccgtactccagaaaacttgataactgaaattaggagctcatggagaaaagctattgaaatggaagaaaacagaactaaagaaccaattcaaatggatgctgaacatagagaagtattgccagaatcattacctgtgttgcacaatcaaagagaatttagcatggctgattttctcttagaaaccactgtatcagattttggccagtctcatttgactgaagagaaagttatttcagattgcgagtgtgtgcctcagaaacatgtgctgaccagtcacatagatgaaccaccaacacaaaatcagtcagatttgttaaataagaaagtaatttgcaagcaagatttggaatgtttagccttcaccaagctttcagaaactagccgaatggagacattctcccctgctgtcggcaataggatagatgtgatgggtggcagtgaagaggagtttatgaaaatattggaccacttagaagtttcttgtaacaaaccttccacaaataaaactatgttgtggaattcttttcagatatcaagtggaattagttctaagagttttaaagataatgattttggcatattacacgaaactctcccggaagaagttggtcatctaagttttaatagttccagtagttcagaggccaattttaaactggagccaaatagtcctatgcatggtggcactcttctagaagatgttgtgggagggagacagactactccagaatcagactttaatttacaggctcttcgcagtagatacgaggctctgaagaaatctctttccaagaaaagggaagaatcttacctctcgaattcccaaacacccgaaagacacaaaccagaattgagccctactccccaaaatgtacaaacagatgatacgcttaactttttggacacctgtgatttgcatactgagcatataaagccatctttacgcacgtccatcggtgaaagaaaacggtctctttcaccactaattaagttttctccagtggaacaaagattgagaaccacaatagcatgtagtcttggagaactacctaatttaaaggaagaagacattttgaataagagccttgatgcaaaagaaccaccgtctgacttgacaagatgaagacgtacccatttaatataactatgatgcacttaaattgaagctatgccacaggatagaaaatgaattacaacttaaatacatgttggaagtgtaacactgtttttcaaggtttaaaaaaattcctaatgccttttagccttctttaatatttttaggtaaggaaagtatgtttggattttttcctctttgtaggtatatgagattgaaatgtgaagtatttggacaacaaacgtcaagcaatgggaagccattttgatttcttgagtaatcttgtaagcattaagtgaatgacaaagtagtagtgtaacttatttcttatgttataacttcagtcaattaatataaggatagtttttgttgtatgttcactaaatggttaatataatagccattgaatatactaatctttcatcttagagaactatacaacttttattgtttcttaatggaacattctggctaaccagaaaaagtgagaaaagtagtaccttgggatgtgtagtcaagatgacaaattttaagactggaaaagctctaaacaggcttaatgattcttcaggtagaatgatcctgagaagtgatgtttgatggaataaagtgcatgtgatgattaagtgaagactggggcagaatgatttaaaaaaaggaaaaagatggaagatgagtagacacttgcaaggaacactgtcaaactataaatccattcagtgggttgtataacatttatatttagtctaatttagactttgataatttaatgctacttttatattttaacaaaaatataaattaaaattttcattagtctgttttgttgttgggtttttttgtgaggtactccctgttgggggaaaggaacaaggaacaaccatcagaatcccccagtccctacagaatagcctcacagtaacttgagaaaactgaacttggggttaaataacttgtcacacttgcagtctcctgcctcactccttcaggtgccctgcctagaaaaagacttgtgtctagcatccaagtgaacacatactattgccctctgtgaaccaggaggaatggaacaggcaatggaagggtgatagtacctacaataccctttgtagaccccatctcactaccatcaaaatcttgtccactagcccccaaaaaactggcaaggaaagaaggtggaggggaaatttatggaagtagatggcttaatagttatttcttttatcttgggctgcctttctctaagttggttgtcctgtcccagtgtgaagacccatctttttgtgagaaaagacaaaagaaagcacatgtaactaccttctttgcaatggaaaaggagaaagaaaaaatcttctcctaagttgctgttttcttttattagttaataaaacaaatcagggactatgcaggtctatggggaaacctttagtctgctttaagaaaactcagtatctgaaaatcttaacttagcatgtgatactgtcttatcagcatctgcagaagtgccaaagccactgctagacacttaatgtgtattatttcatttaattatattttaaatgtgcttccttggtaattcttaagctcgagaaagagtttgagaactgctgctaggaaatagagattcacatttaaccctgtggtacttttaagaagcaggtacgttgttgcatatatacttgggtagagattggtaactatctgatagggaagctcaagttggccacccaagtctgagaaacccttaattactgagaatcaaaagagcagaatgtctgtagacattttggatttgtaaaaatcacattgttgagttatacctgtgatgggctgaaagtttttggcattctttcctgttcttcatatgccagtaccataaacaaaaagtatctcagatctgtcactttcttctcctaaaccaatgtgattgcagctttttgccttcagccttttccctatccagtatctcctacatagttaccttttgatcttaaggaactgttttgattgggtcacttccttgcctaaaattccattgattgttcattgttaattctaaaatagagttcaaatttaaaggcatgtaagttcccctgtaacggatttcctctactcccccttccgctgtaatctcccatttttttactgaaatgcttcagtgagcatgggtctttagaggtcttgatatacaattttcctgaagcaggaataccttgctttcctctactagtttaccacaattacagctctcttttaagcctcagaaaaaaatctcacttccgtcttgaagtcttaatccacgctttttatatccatgtgcctactccttctctgaaatctcctatggtttatctttttattcatttaatatcccacgaattgattttattatatattttttatggttgcatgtggtctttctagttatagcaatatacacatacatgcataaatacatatacacctatgtaaatgtgtgttgggagtatgtattcacacacatacatataccccaaggccatgtgtcatctttatcaatatttaagttttggaattgttttgtttgcctcctatatcatggaataaatggtaaagagggctaatttattactctaagtggatttcttattacattaatatcagacatatagaatgtactttgttttactatttgtaagatacaaaggtatataaactgacatacatcagcttgaaacctgagataatgctaaaatgttctaattattttaaatgtttaaagaggacaaccatgtaatgttgctaaacatgaaaaatgtcatcaagtggaataaagaatagctgaagttaacatttgggggaaattgagctgaaaacaaaaatatgagtattttgataccttttctttaccatgagactcttgactatgaagtcaaatttatctaaaggaaaaacaggaattctggagacctgtgtaaaagcagactattatcttcctactgtgagagtactaaaattaaaatacgtttaatgacgttttcctcaatgtaaaagcattgaagtaaatgtttcttttatgttgcagatacatagttgctctagagatcacctttttctttatgcattgtgaatagcagtctgcatcctaagtttaaaatatttgagaatcctctatgggactctctgtaaatgttttaaatactgttgttttcaataaatattttatactaaaaaaaaaaaaaa

SEQ ID NO: 552 - DNA, 829 bp, Homo sapiens
cctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctg

SEQ ID NO: 553 - DNA, 6117 bp, Homo sapiens
ttcgagcttcccggctgctttgtttacctaatcaagcctgggcaatggcgggcgcccctcccgcagcctcgctgccgccttgcaggttgatctcagactgctgtgctagcaatcagtgagactccgtgggcgtaggactctccaagccagtgagatgaactcggtatctcagatggaaatgcagaaatcaccgtcttctccatcgctcacgctgggagctgtagaccggagctgttcctattcggccatctttgctcctccctgcaactaactccattcttaattgaccatcaaggaaatttccatccacacagattagcagttgaaaatgaagctgcacacatacatgtaagagaagcaaaaatgtcagatgatatcaggaaaaggtttgaatttccaaattctcttatccaatcacaggctgtgggtcatcttattgctgcagtcctaaaggaaaatggtttttcagaaaagattcaccaatctacaaatcagactcctgctttgaacttgctgtgggagaagtgttgcagtgacaatgtagtggttcgaacagcctgctgtgaaggtctggtggcactcgttgctcaggatcatgcagagttcagctatgttctcaatgggatactcaacttgattccatcaaccagaaatacacatggcttgataaaagccattatgcacttactacaaatgcaagctcttaaggaaggacaaggtggggaaaagaatattcagagtatatataccattagaaatcatcctcatcctttgataactgtgcttgaacacagacctgattgctggccagtgtttttgcagcagctgacagcgtttttccagcagtgccctgaaaggttagaagtttcatgcattcaaataatggcaccatttctgtggtatctgtattgtgaaccatctcagttacaagaatatgctaaactccgactagccctgctgaaagtcttacttcaaccccaggttctttgtgacaaagatcaaccatcaatactggaacagcagatacttcaactgtgttgtgacatagttccatgtttgcaggtaaaagatttgatacagacaacagaggcgatgatgtttattgaggaagtatgtttaagccttttgcgtcatcctgttttctggaaaattcagcttacccagatgagtcttcagctgctgtgtgtcagtgaagtcagcttaaagataactggtgaatgttcatcttcaattcaccttttagagcacagtgttgaacttctgaaggaggattttcctgttgaactggtcataattggaatagctttactacttctacagactccagcaagtcagcagaagccaatcttaaatctagctttgaagctcctctctgttactgaggatcagaaaatcccaaagtcctctctgctgctagtgatgccaattctgcagatactatcttctactgccttggaagactgtatatctgtggatgaagaaggtccctctaggcagcagttggctctaaaccttttggaaatgatacagcaggaatgttacagagatgaccaccaaaagctctcctacaagcttgtgtgccctgtaaccagtatgtatggtacaatatttacagcctggaggattcttgaagtaatgacagactcgtctgctgcaagtgactggttggcttcagtagagtcattgcttcctattactgctgtgatccctgcgcctgcctttcttctgctggctcacctccttgttgaagacaaaggacaaaatcttcaccaaatactcaaggtcactacagaattagcccaagtagattcctcccaggtgccaaatctgattccagttttgatgttcaaattgggaagaccactggaacctatattatataatgatatattgtatactttacctaagcttggtgttcacaaggtgtgtataggacaaattctacgaataatacaactacttggaaccacaccacgactaagagctgtcactttgcgcttgctgacatctttgtgggaaaagcaggaccgagtctatcctgaactgcagcgtttcatggctgtgtctgatgtaccttctctttcggtgggcaaggaagtccaatgggagaaactgattgcaaaagcagcatcaatcagagatatatgtaagcagaggccatatcaacatggtgcagatatgttggcagctatttctcaagtgttgaatgaatgcaccaagcctgatcaagctactccagcagccttggtattacagggtcttcatgcactctgtcaagctgaggttgtttgcattcgctccacttggaatgctctctctccaaagctgagttgtgacacaagacctctcattctgaagacactgagtgaactattttctctagttccttccttaacggtcaatacaactgaatatgagaattttaaagttcaagtcctcagcttcctctggactcatactcaaaacaaggacccaattgtagcaaatgctgcatatagatccctggccaactttagtgcaggagaacacaccattcttcatctgcctgaaaagataagaccagaaattcccattcctgaagagttagatgacgatgaagatgttgaggatgtggatctttcagttcctggctcttgctatctcaaactgttgtcactcactccccctttggttttaccagctttggaggaattttttacatcacttgtgaagcaagaaatggtgaatatgcctcgtgggatatatcactctgcattaaaaggaggtgcccgctcagaccaaggaaagactgtagcaggaatccccaattttatattgaaaatgtatgaaacaaacaagcaaccaggactgaaacctggccttgcaggtggtatgttattttgctatgatgtttccatgtatcagagtaaagatggaaaaccattgaacagactgatggccagcagagggcgaagtttcaagcagacttcacttgctcttgtacatgaggttcatatccagctttcagagtggcaccgtgcaatttttcttccacaggcctggcttgcatacatgaatcgagcttatcatgccattttacagggaagactaggagagctggagttgcagttaaaacatggaaaagaagaacctgaggaggtgcagtacaaaaaaagcacagcctggctctgggttagagacatgctgactgatgagatcaccaaggcagctgcaaaggagagtccggtagtgaaaggcaatgcgctgttagctctaagcagccttgctgtcgtcgtatctagacatgaagccagcctctcctcagactctgacgggctcctggaggttcaacctaatttcctttcaatgaaagagtgggtttccatggtacttgatacactcttggtcattgtggatagccattaccaacccagagggcaacttctctcctggttttattataagtcctattctggtgaaaacacagctagtgccattgcccgttctgctgccgccacggctttgtctctccttgtgccagttttcattatctcttgcaaagagaaggttgaggaaatcctgaacatgctgactgccaggttacctgggaaaccaagtgctgatgagtctcaagccgtgcaaatccacatgggccttgctttagggatgtttctctctcgcttgtgtgaagagaaactcagtgatatatctggccaagagatgaaccttcttctgatgaagtcgttggatgccctggaaaattgctgctttgacactagtcttgaatacaacacgggctgtatattgggagttggacttgttctgtccctcatgagccacagcagccaaatgcagtcccgcgttcacgtagcagcattgctccggaagctgtctgcgcacgtagatgacagcgggagccagagcagaacgtttcaggaggtccttgcctacacacttagctgtgtatgtacatcagcgttcagtgctggaattattgaggctacagaggctgaggatgttatgaacaagcttcgactgttagtggagaatagccagcagacttcaggttttgccctggctttaggaaacatagttcatgggttgtctgtgtgtggacatggaaaagctgaagacttgggcagcaaactactccctgcctggatcagaattgttctaacagagggcactcccacaatgctttgtctggcagctcttcatggcatggtggccttggtaggctctgaaggggatgtaatgcagctgaaatcagaagccatccagacctctcattttcaaggcagacttaatgaagtcattagaaccttaactcaggtcattagtgtctctggggtgattggtctccagtcaaatgcagtctggcttcttggacatcttcatctatctactctatcctcaagtcaaagtagagcctctgttcctactgactatagctacttgcctgaaagcagttttattggagcagctattggcttcttcattacaggaggaaaaaaaggtcctgaatctgtgcctccttcccttcttaaagtagtgatgaaacccatagcaactgttggagaaagctaccaatatcctcctgtgaactgggctgcacttctctctccacttatgaggctaaattttggtgaagagatccagcaactgtgccttgaaattatggtgacccaggcacagtcatcccagaatgcagctgcactattgggcttgtgggtgacaccaccactgatccacagtctgagtctgaataccaagagatatctcctgatatctgcacctctgtggataaaacacatctctgatgaacagatcctgggttttgttgaaaatttaatggtggcagtttttaaagcagcttccccacttggaagtcctgagctatgcccaagtgctttacacggtctgagccaggccatgaaactgcccagccctgcccaccacctctggagtctgctctctgaagctactgggaaaatttttgacctcctgccaaataagattcggagaaaggatctagagctgtatatcagcatagcaaaatgcctcttagaaatgacagatgatgatgccaatcggatcgcccaggttactaagagcaacatagaaaaagctgcctttgtcaaactgtacttagtctctcaaggacgattccccttggtgaacctgaccgatatgctgagcgttgctgtgcagcaccgtgagaaagaggtgttggcctggatgattctgcacagcttataccaggcacggattgtgagccatgccaatacgggcgttttgaagagaatggagtggctcttggaactgatgggttatattagaaatgttgcttaccagtcaacatcctttcacaatacggctcttgacgaggctttggacttcttcttgctgatatttgcaaccgcagtggttgcatgggctgaccacactgcccctctcctcctcggcctcagtgccagttggttgccatggcatcaggagaatggcccggctgggccagtaccaagcttccttggcaggagtccaatgcacagggtcactctgcaggaggttctcactctccttcccaatagcatggctctgctgctgcagaaagagccatggaaggaacagacccagaagttcattgactggctattcagcatcatggaaagccctaaagaagccctctcagcacagtccagggatcttttgaaagccaccctgctgtccttgagagttctcccagagtttaagaagaaagctgtatggaccagagcatatggttggtgaacagttttgcagtaaccagcagcattctcagctggatgaggaaaaccatataagtggaagaagtttttcagaattcatgcctggtattgctgagacatgatgcagagagttaagggtcatgaaaagatggccacatcactgacagcttgacacatgcctcctaagagaggagtgcattgctttagtacccgggccagttgagactgaaacaggaacttggattttctttatttggcttgagttcaatgtggagattttctttgtgaaagcttgaagatattatcttctccctgctaaattccagtaaaataatgttgtcaattttgaaaaaaaaaaaaaaaaaaaaaa

SEQ ID NO: 554 - DNA, 4373 bp, Homo sapiens
cggctcggtgttggggctaggccggtattctaggcccaagcccaggcccaggcctgtgttcccggcccttgctcaaagacaggccggtggccgctgcgacactctaggtacagcggagggcgcagcgggccgttcgctgaggtgtccggacccgccgccgagcgggccgtggagccacagtacgtggcggcgcctcttccttgcccgaagcggaactgctgaaggagcggcagcgcaggccggacgaggtgaaccaggtcatttaaccgccttcaggtgatgaatcatctgtctaataatcagatttgaggtccacagccctttgtggtcctgctacagggtgattttcagtggatgactgactggcgtggcccgaggggtgccgcagtgactgccttcccttgataaggaaacgagctttctgttctttctggacacctcgttacctgtaaaacattccggttataacttctttatccggcttgcatctctgtgcaagaggaaagctttcacatgaaagtgtcccttggtaacggcgaaatgggcgtctctgcccatttgcagccttgtaaggcaggaaccacacgcttttttaccagcaatactcacagttcggtggtattgcaaggctttgatcagcttagaatagaaggattgctttgtgatgtgaccctggtaccaggtgatggagatgaaatcttccctgttcacagagctatgatggcgtctgctagtgattatttcaaagccatgttcacaggtggaatgaaagaacaagatttgatgtgcattaagcttcatggggtgaacaaggttggtctgaagaaaatcattgattttatttatactgcaaaactttctcttaatatggacaatcttcaggacacacttgaagctgctagctttttacaaatattacccgttttggatttctgtaaagtatttcttatatcaggagtctctttggataactgtgttgaggttggacgaattgctaacacctacaatcttatagaagtggataaatatgttaataatttcatcctgaagaactttcctgctttattgagtactggggagtttctaaaactcccttttgaacgacttgcatttgtgctttccagtaatagtcttaagcactgtaccgaacttgaactctttaaggcagcctgtcgctggctaaggttggaagaccctcggatggattatgctgcaaagttaatgaagaatattcgatttccactgatgacaccacaggatctcatcaattacgtgcagacagtagatttcatgagaacagacaatacctgcgtgaatttgcttttggaagctagcaattaccaaatgatgccatatatgcagccagtgatgcagtcagatagaactgccattcgatctgactccactcacttggttacattaggaggagttttgaggcagcagctggttgtcagtaaagaattacggatgtatgatgaaagggcacaagaatggagatctttagccccaatggatgctccccgttaccagcatggtattgctgtcattggaaactttctttatgtagttggtggtcagagtaattatgatacaaaaggaaaaactgctgttgatacagttttcagatttgatcctcggtataataaatggatgcaggttgcatcattaaatgaaaagcgcacattctttcacttgagtgccctcaaaggacatttgtatgcagttggtgggcgcagtgcagctggtgaactggccacagtagaatgttacaacccaagaatgaatgagtggagctatgttgcaaaaatgagtgaaccccactatggtcatgctggaacagtatatggaggcttaatgtatatttcaggaggaattacccatgacactttccaaaatgagctcatgtgttttgacccagatacagataaatggatgcaaaaggctccaatgactacagtcagaggtctgcattgcatgtgtacagttggagataagctctatgtcattggtggcaatcacttcagaggaacaagtgattatgatgatgttctaagctgtgaatactattcaccaacccttgaccagtggaccccaattgccgccatgttaagaggccaaagtgatgttggagttgccgtctttgaaaataaaatctatgttgttggtggatattcttggaataatcgttgtatggtagaaattgtccagaaatatgacccagaaaaagatgagtggcataaagtttttgatcttccagagtcacttggtggcattcgagcctgtacactcacagtttttccacctgaagaaaaccctgggtcaccttctagagaatcacctctttcagcaccttcagatcattcttaggtctaaggtgtaacacctttgcagtacgtcatgggtgatctaatacttccccttcagttgtatcttcttacagtgattggtacagttattagatataaaggtaactgatgttattcgtcttgtatggcttttagtatgtttatcaagtggctaacaaatgcattctgaaaatgtatttaacatagctgttttaacaaatgaaaaaaagacgtagaaaaatgtttagatgtctttttgtgatgttatataaaattgtagatgactgtggtaaatgtgtaattatgtccattatgcttcaaagttgagttttcatctttgactccaaaatgtcagagggaggccgctctaaactaaaaataacgaaaggttgccaagtattaatactagttacctccctcttttcgtagtttttgtcatgtctgtcaacttactcgattgtgtggttgcattcagaatatttgaagtttcttacgtagacagaaataataaaaatattaactaggaaaaaacagtatagcaccaagccagtatttggtatctctctctagagcgagcaagagagggagagaggaggaaaaaatacacataatacaaacatacatgcatgcacacatacatacatatgtatacacacacataatttgaaaactgattggcacttcaacgatgctgaaattgtttttaaattgaagtttctttcttccacaaagcagccgtttctattcaaatggaaattcagtaccagagaataaatgtctatgtagtcatactgaatttagatagataagggctacagcatactaaatcgacaaccaaatttgtcatgtgactaaaccgttacttcagatgaagcttacattactgttttctgcttgtgtattttctgtagagtacttttacacagattggtaaagttcaggtttcagagaactgcttttgtgcagaaaatttaggttcttttttccacctttttggtcagtaaaacttaatgaaaaaagcaaagaaaaaaatattctgaacaaagctatagggttttaagttcagcctcccaacttagtcatcctaacatgattattttgtgatttggggtgcttgccctggtgctgttccagtccatgtgcatcctgagctgtgtgatctgcctcgaggctatgatctgagcaagcaggagataacattttcttctgcatcaagtgaggaaaaatgtgcttttggccatgtctcaaagacaggaccaacttcagattcccaaagaagccagctacagagcctctggaacactatggtcttacaagcagtactaaaatcaaccctcagcctcttcaatgccaaaggtatccctattggttgagaaccacatggtaatttttaatgggacttttatcagcaaatggagttacaggaattctctgtaatgagtgattctgaagaggtactttcctggaataattgtctacctgaagaaaaaaaatttatatatacattgtgtgtgtgtgtaatacacacacacacaaccccctatacctggaagattgtcagcatgtaaatcaggaacaactttctccttattgacaatcccataataaaactcaggaaccaaggcaaaatgaattggcttctaggggtctgaaccttactgcccatacaagtgttgattcattttaatgctgtttatgatttctgcattggcagaaattttcatactttctatgtttttttaattactcagttttttattactaaaaatagcacatttgagtacatttgaaaagtagaaaaattagaaattattaactttattgaataagcaagaagtgcatcctaatcctttgattattaatgaggttgaatatttgtgtgctatcggtagctgtgtttctttgatcaaatgttcctgtccttttgcccttctgttatctgttggagttgctttgtttttcgtatcaagttataggatctctttatataataaatgtaatttaacttgaaaaaaaaaaaaaaaaaaa

SEQ ID NO: 555 - DNA, 2260 bp, Homo sapiens
gaattccgctccgcactgctcactcccgcgcagtgaggttggcacagccaccgctctgtggctcgcttggttcccttagtcccgagcgctcgcccactgcagattcctttcccgtgcagacatggcctctggcaccaccaccaccgccgtgaagattggaataattggtggaacaggcctggatgatccagaaattttagaaggaagaactgaaaaatatgtggatactccatttggcaagccatctgatgccttaattttggggaagataaaaaatgttgattgcatcctccttgcaaggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggaccactatgagacctcagtccttctatgatggaagtcattcttgtgccagaggagtgtgccatattccaatggctgagccgttttgccccaaaacgagagaggttcttatagagactgctaagaagctaggactccggtgccactcaaaggggacaatggtcacaatcgagggacctcgttttagctcccgggcagaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcagtttcggtggaccgggtcttaaagaccctgaaagaaaacgctaataaagccaaaagcttactgctcactaccatacctcagatagggtccacagaatggtcagaaaccctccataacctgaagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaaaccccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtcctttggtgctgggaactctacatctagcaatttctctttaaaaccatatcagagatgcatacaaagaattatatataaagaagggtgtttaataatgatagttataataataaataattgaaacaatctgaatcccttgcaattggaggtaaattatgtcttagttataatctagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttttattttctttgaatctttctgtgtcttcacatttttctacagtgaatataatcaaatagtaaagggccgtaaaaataaaagtggatttagaaagatccagttcttgaaaacactgtttctggtaatgaagcagaatttaagttggtaatattaaggtgaatgtcatttaagggagttacatctttattctgctaaagaagaggatcattgatttctgtacagtcagaacagtacttgggtgtgcaacagctttctgagaaaagctaggtgtataatagtttaactgaaagtttaactatttaaaagactaaatgcacattttatggtatctgatattttaaaaagtaatgtgagcttctcctttttatgagttaaattattttatacgagttggtaatttgtgccttttaataaagtggaagcttgctttttaaaaaaaaaaaaaaa

SEQ ID NO: 556 - DNA, 1218 bp, Homo sapiens
cccaacctggggcgacttcaggtgtgccacattcgctaagtgctcggagttaatagcacctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactc

SEQ ID NO: 557 - DNA, 1275 bp, Homo sapiens
cctccctacgggcgcctccggcagcccttcccgcgtgcgcagggctcagagccgttccgagatcttggaggtccgggtgggagtgggggtggggtgggggtgggggtgaaggtggggggcgggcgcgctcagggaaggcgggtgcgcgcctgcggggcggagatgggcagggggcggtgcgtgggtcccagtctgcagttaagggggcaggagtggcgctgctcacctctggtgccaaagggcggcgcagcggctgccgagctcggccctggaggcggcgagaacatggtgcgcaggttcttggtgaccctccggattcggcgcgcgtgcggcccgccgcgagtgagggttttcgtggttcacatcccgcggctcacgggggagtgggcagcgccaggggcgcccgccgctgtggccctcgtgctgatgctactgaggagccagcgtctagggcagcagccgcttcctagaagaccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactc

SEQ ID NO: 558 - DNA, 897 bp, Homo sapiens
tgtgtgggggtctgcttggcggtgagggggctctacacaagcttcctttccgtcatgccggcccccaccctggctctgaccattctgttctctctggcaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatataagccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactc

SEQ ID NO: 559 - DNA, 1515 bp, Homo sapiens
cccaacctggggcgacttcaggtgtgccacattcgctaagtgctcggagttaatagcacctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtgggtagaaggtctgcagcgggagcaggggatggcgggcgactctggaggacgaagtttgcaggggaattggaatcaggtagcgcttcgattctccggaaaaaggggaggcttcctggggagttttcagaaggggtttgtaatcacagacctcctcctggcgacgccctgggggcttgggaaaccaaggaagaggaatgaggagccacgcgcgtacagatctctcgaatgctgagaagatctgaaggggggaacatatttgtattagatggaagtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactc

SEQ ID NO: 560 - DNA, 2260 bp, Homo sapiens; identical to SEQ ID NO: 555

SEQ ID NO: 561 - DNA, 3065 bp, Homo sapiens
gggcggggcggccgcgggtcgcgggcggatgacgcgccggggccggcggaggagcagccacttcctggggccgccggccggggccgctggctgcactcagcgccggagccgggagctagcggccgccgccatgtcccaccagaccggcatccaagcaagtgaagatgttaaagagatctttgccagagccagaaatggaaagtacagacttctgaaaatatctattgaaaatgagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacgacagattaaaatcaatgaggtacagactgacgtgggtgtggacactaagcatcaaacactacaaggagtagcatttcccatttctcgagaagcctttcaggctttggaaaaattgaataatagacagctcaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccatagtttttatttattcaatgcctggatacacatgcagtataagagagcggatgctgtattctagctgcaagagccgtctgctagaaattgtagaaagacaactacaaatggatgtaattagaaagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtagggaaaaaaattgtactttttggaaaatagcacttttcacttctgtgtgtttttaaaattaatgttatagaagactcatgatttctatttttgagttaaagctagaaaagggttcaacataatgtttaattttgtcacactgttttcatagcgttgattccacacttcaaatacttcttaaaattttatacagttgggccagttctagaaagtctgatgtctcaaagggtaaacttactactttcttgtgggacagaaagaccttaaaatattcatattacttaatgaatatgttaaggaccaggctagagtattttctaagctggaaacttagtgtgccttggaaaaggccgcaagttgcttactccgagtagctgtgctagctctgtcagactgtaggatcatgtctgcaacttttagaaatagtgctttatattgcagcagtcttttatatttgacttttttttaatagcattaaaattgcagatcagctcactctgaaactttaagggtaccagatattttctatactgcaggatttctgatgacattgaaagactttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttatgggcaaattgtgttctttatcacttccgagcaaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattgtgggttgacagatttttaaaatagaatttagagtatttggggttttgtttgtttacaaataatcagactataatatttaaacatgcaaaataactgacaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctctttaaaaaaaaaaaaaaaaaaaaaa

SEQ ID NO: 562 - DNA, 3455 bp, Homo sapiens
gggcggggcggccgcgggtcgcgggcggatgacgcgccggggccggcggaggagcagccacttcctggggccgccggccggggccgctggctgcactcagcgccggagccgggagctagcggccgccgccatgtcccaccagaccggcatccaaggtaacagcgcccggcgcgactcgcagggaaggggcttccgggagagccgggagagccgggagggctgcaggaccggcagggctggagtcgggccgggagctccggaagtcggtctcgcggggcgagccgggcctcggcgcctctccgcgctcctgcttcccgggcgctgccggcctgcgtcctcctccagcccggtccctgctgccgtcacgttgcagattgatccgaaattcgggggagcgaaggaaattggctttcgaggcggcctggttgaagggggcgtgccttccaccgtccccgacagtcgcccaactttcccccttttggtcacgtagggaagagctgggacagtggaggcgactggggcttcagtacgctgtcgagaaccagcaagtgaagatgttaaagagatctttgccagagccagaaatggaaagtacagacttctgaaaatatctattgaaaatgagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacgacagattaaaatcaatgaggtacagactgacgtgggtgtggacactaagcatcaaacactacaaggagtagcatttcccatttctcgagaagcctttcaggctttggaaaaattgaataatagacagctcaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccatagtttttatttattcaatgcctggatacacatgcagtataagagagcggatgctgtattctagctgcaagagccgtctgctagaaattgtagaaagacaactacaaatggatgtaattagaaagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtagggaaaaaaattgtactttttggaaaatagcacttttcacttctgtgtgtttttaaaattaatgttatagaagactcatgatttctatttttgagttaaagctagaaaagggttcaacataatgtttaattttgtcacactgttttcatagcgttgattccacacttcaaatacttcttaaaattttatacagttgggccagttctagaaagtctgatgtctcaaagggtaaacttactactttcttgtgggacagaaagaccttaaaatattcatattacttaatgaatatgttaaggaccaggctagagtattttctaagctggaaacttagtgtgccttggaaaaggccgcaagttgcttactccgagtagctgtgctagctctgtcagactgtaggatcatgtctgcaacttttagaaatagtgctttatattgcagcagtcttttatatttgacttttttttaatagcattaaaattgcagatcagctcactctgaaactttaagggtaccagatattttctatactgcaggatttctgatgacattgaaagactttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttatgggcaaattgtgttctttatcacttccgagcaaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattgtgggttgacagatttttaaaatagaatttagagtatttggggttttgtttgtttacaaataatcagactataatatttaaacatgcaaaataactgacaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctctttaaaaaaaaaaaaaaaaaaaaaa

SEQ ID NO: 563 - DNA, 3065 bp, Homo sapiens; identical to SEQ ID NO: 561

SEQ ID NO: 564 - DNA, 3455 bp, Homo sapiens; identical to SEQ ID NO: 562

SEQ ID NO: 565 - DNA, 1839 bp, Homo sapiens
gagactgcagagggagtagtgcgatcctgcgcgcgggggaactagctggagggcaaggcgggaacaccatctattgttggggtgatcggacctaacaccaggttgtggggacaacgaagtccagaagagtgaaaggaatgagaaaagacagtttgagagagaaagtgggcccagggggccaatgcgagtatggaggctgtgaaggccccgagccctggaagcccagactatttattggtgatcaaacaaagaaacaggtggggaatattgtcctattatgattctcctgaagatgcctggaaaggttgcaaagggagcatacaaatggcagtctgtgaaattgaagttcattctgtagataatacatgcatggacctgataatccccggggaacagtatttctacctgaaggccagaagtgtgcctgaaagatagcggcggctggtggccctgggatcagccaaggcttgcctgactgacagtaggacccagaaggataaagagtttgctgaaaacactgaaaacttgaaaaccaaaatgtcagaactaagactctgctgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagattgcaaatgcagccttcacctctgagctgctctaccacactccaccaggatcaccacagctggccatgctcaagtccagcaagatgaaacatcctattataccaattcataattcattggaaaggcaaacggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataaccgtccaaggtgaaataatgaaggaagatagaatggaaaacctgaaaaatcatgacaataacttgtctcagtctggatcagactcaagttgctctccagaatgcctctgggaggaaggcaaagaagttatcccaactttctttagtaccatgaacacaagctttagtgacattgaacttctggaagacagtggcattcccacagaagcattcttggcatcatgttgtgctgtggttccagtattagacaaacttggccctacagtgtttgctcctgttaagatggatcttgttgaaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggaaaaggatatccagacagccctgaataacgcatatggtaaaacattgcggcaacaccatggctgggtagttcgaggggtttttgcgttagctttaagggcaactccatcctatgaagattttgtggccgcgttaaccgtaaaggaaggtgaccaccggaaagaagctttcagtattgggatgcagagggacctcagcctttacctccctgccatgaagaagcagatggccatactggacgctttataagaggtccatgggctggaatctgatgaggttgtatgatggctgctgggcagcacctcctaacttcagggaataaagtgctaaagtgtaaaaaaaaataaaaataaaaataaataaataaataaaatt

SEQ ID NO: 566 - DNA, 5307 bp, Homo sapiens
gaataacagttaagttttggggagtaaaaactgtttcaatttttgactgtgttgggggttggtgctcctaatccctgtgttgttaaagggtcgactatattgtatttttgaaaattgctagagagtggacgtaaagtgttctcactaaacaaattataactatgtgaggtagtgcatatattaagtagctagatttggtcattccacaatgtatatgtacttcaaaacatcatgttgtacatgagaaacacagttttatctgttagtcagttttaaaaataaaaaatattccaactagaaactctgttgtagtttttgaaattacaacttggaggctttgaggaactgattagaagtctcctttctgtttcaggctttcatatccaaaccatagatctttagaagtaacatctgttaattaattattaataaatagtttgagtctttattaattcatggataacttgaccattttctctctccttttgcttagataatcccagatcatggccgggcacagtagctcacgcctgtattcccagcagtttgggaggccgaggcaggcagatcacttgaactcaggagtttgagaccagcttgggcaacatggcaaaaccctgtctctattaaaaatacaaaaattagctgggcatggtagtgcatgcctgtagtcccagctacctgggaggctgaggtgggaggatcgcttgagcctgggaggttgaggcttctgtgcgcgatgattgctccagtgatcacgccattgcactccagcctgggtgacagagtgagaccctgtctccaaaaaaaaaaaaaattaagcaagtagcagttacaagaccaaaagttattttcctttttttttttctctataaaattgcccatttggaccaaatctagttataacttatttcagtgtcattaagaaagttgatgaataagtcatattactcagatgttagtagctatgcatttattaatagttttatttataagtatttagtttcactctgttgcagactattttatgctaaaattagctaaagccaaattactatttcttaaaacatattttttactttttttttttttttaaatattattaggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttggtgaggaaggggaagttaaaaaactcgagaatacaggtatagaggctaatgttttgtgtttggaaagtgagatttctgaaaatattcttgaaaaaggaggtgatccattggaaaagcaagaccagatatctggactttcacaatcagaggtaaagacagatgtatgtacagttcatcttccaaatgattttcctacatgtttaacatctgaaagcaaagtgtaccaacctgtatcttgtcccctaagtgacttatctgagaatgtagagtcagtggttaatgaagaaaaaataacagagagttccctagtagaaattactgaacataaagattttacactaaaaacagaggagcttatagagagccccaagttagaatcttctgagggtgaaattatacagacagtggacagacaatctgttaagagcccagaggttcaattgcttgggcatgttgaaactgaagatgtagaaataattgcaacatgtgatacttttgggaatgaagatttcaataatattcaagactctgaaaataacttactaaaaaataatcttctgaacaccaaattggaaaaatctttagaagaaaagaatgaatcgctgaccgaacatcctagatctacagagttgcctaaaacacacattgaacagattcagaagcattttagtgaggacaacaatgaaatgatacctatggagtgtgattcattttgcagtgaccaaaatgaatctgaagttgaaccatctgtaaatgctgatcttaaacaaatgaatgaaaattctgtgacacactgttctgaaaataatatgccgtcttctgatcttgcggatgaaaaggttgaaactgtttctcaaccatctgaaagcccaaaagataccatagataaaaccaaaaagcctcgtactcgaagatctagatttcattctccatctacaacttggtcacccaacaaagacactccacaagaaaagaagcggccccagtctccatctcccagaagagaaactgggaaagaaagcaggaagtctcaatcaccatctcctaagaatgagtcagccagaggccggaaaaaatcccgttctcagtccccaaaaaaggatattgcaagagaaaggaggcaatctcagtctcggtctccaaaaagggatactactagggaaagcagaagatctgaatcactgtccccaagaagagaaacttctagagagaacaaaagatctcagccaagagtgaaagattcttccccaggagaaaaatccaggtcccagagcagagaacgagaaagtgatagagatgggcagaggagagagagagaaaggagaaccagaaagtggtctaggtccagatctcattctaggtccccctcaagatgtagaacaaaaagtaagagttcatcatttggtagaattgacagagatagttactctccccggtggaagggaagatgggcaaatgatggttggagatgtccacgaggaaatgatcggtacagaaagaatgacccagagaaacagaatgaaaatacaagaaaagaaaaaaatgacatccatctagatgctgatgatccaaattctgctgacaaacatagaaatgactgtcccaattggataacagaaaaaataaactctgggcctgatccaagaaccagaaatccagaaaagttgaaagagtctcattgggaagaaaatagaaatgaaaattcaggaaattcttggaataaaaactttggttctggttgggtatctaaccgtggtagaggcagaggcaaccgtggcagaggcacttacagaagtagttttgcctataaagatcagaatgaaaatcggtggcaaaatcgaaaacccctctcagggaattcaaacagttcagggagtgaatctttcaagtttgtggaacagcaatcctataagcgaaaaagtgaacaggagttctcatttgatacaccagcagatagatctggatggacatctgcatccagctgggccgtgagaaagactttgccagcagatgtacaaaactactactcacgacgaggcagaaattcttcaggtccacagtctggatggatgaaacaagaggaggaaacatctggacaggattctagcctaaaagaccaaacaaaccagcaagttgatggttctcagctacctataaatatgatgcaaccgcaaatgaatgtaatgcagcaacaaatgaatgcacaacaccagcctatgaatatcttcccatatccagtgggtgttcatgctcctttgatgaacatccaacgcaatccatttaacattcatcctcagctacccttgcatctccacacaggagtgcccctcatgcaggtagccactcctaccagtgtatctcagggactaccaccaccaccaccccctcccccaccatcccaacaagtcaactacattgcttcacaaccagatggaaagcaattgcagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaagaaattgcaaattcaagaaaaagcagcacaagaggtaaaattggccatcaagccattttaccaaaataaagatatcaccaaggaagaatataaagaaattgtacggaaagcagtagataaagtttgtcatagtaagagtggagaagtaaattctactaaagtggcaaatctggttaaagcctatgtagacaaatacaaatattcacggaaggggagccaaaagaaaactctggaagaacctgtgtctactgaaaaaaacataggctgaaatggggaacgctgtcaaggacattatcaggatatctgcaaagtgcaatttcaacatgtaccattaactgaaaatcatacataactgtgattgaaatttggttttgataaaattatttttttaacataggatatgatgttttgttctaaataaatataggtctgcactgcaacttctgtatccttccttcccctccaccctcccccacaaaattcaagggaaagtaaagggtttaaaggaatgtgcatctttactaggactgtgttatagtgtggatactggaaaatgtatagctttttgattagggcaatggagtgcataaattagaaacttctaagtgcactggttttcaaagagatatatataatgcatttattctgtcaggttaaaatataaagtatgatctttatgattttttccctctaattatagaaagttaaataatgtattaccatgaaaaatgtttctaatattaaatagaacatatcagttgcaaagttcctaatgtgtatttttaaagcacatatctgaataaattgcctagatagaaaaaaaattatcacgagtaaaatttagtgttcaaaacattgaaacactcttcacctattgtatgaccaaataaaggttatgctgcttgttacgcgaaggcc

SEQ ID NO: 567 - DNA, 1950 bp, Homo sapiens
gctctggcggctcccgcggctccggctggcggcttcgggccctgcacctgtgactctcggccgcgctcgccctcggcccgcccggcgccgcagccccatggccccgtccaggctgcagctcggcctccgcgccgcctactccggcatcagctccgtggccggcttctccatcttcctcgtctggacggtggtctaccgacagccggggaccgcggccatgggagggctcgcaggggtgctggcactgtgggtcctggtgacgcacgtgatgtacatgcaagattattggaggacctggctcaaggggctgcgcggcttcttcttcgtgggggtcctcttctcggccgtctccatcgctgccttctgcaccttcctcgtgctggccatcacccggcatcagagcctcacagaccccaccagctactacctctccagcgtctggagcttcatttccttcaagtgggccttcctgctcagcctctatgcccaccgctaccgggctgactttgctgacatcagcatcctcagcgatttctgacccagggggtgaggtctctgcaccctgggggggccttaggacctggactcagcctctgagatgttgggagaggctactcccaccccctggtgaccccagaactgtggcagaaaatacacagcaggacgagtgtggtctcccaggaagctgtcctgcccgtcccctttcgaggaaacctgagtgtggtagagaggggatcctgccatgttgctcctcatcagcctggccagagggcagctttagaccttttcaaatgaatctgttttcttttctttcttttttttttcttttttttttttttttgagatggagtcttactctgtcacccaggctggagtgcagtagtgcgatctcagctcactgcaacctccgcctcccaggttcaagcaattctcctgccttggcctctcaagtagctgggattacaggcatctgccaccatgcccggcaaatttttgtgtttttagtagagacagggttttgccatgttggccaggctggtctcgaactcctgatctcaggtgattcacccgcctcagccttccaaagtgctgggattataggtgtgagccaccgtgcccggcctggatctgttttcttagcacgcagtgaggaatctttgtacttaaggccagggcaacaaagtcaagaggtcaaggtgtagggccatgaggcctggacctatgctgcaggcaagggtttccatccccgctgccctaggcactctcttcccaaggccaggttgggcacctggggaggtcagttcagaaatatctagcagagacctcttaaacccccatcccagcaccccatcctgttgttcccagagctggtctcccatgagtgtgctagagccagatagccgtggccccccacccatctcactcacacacacaggcatccatacaccccagaagacttcccaaatgaggccagactcagggtcacggggaatgtgcttctgcccctgtaagggctttggggaagggggcaacatagtagaggctggaaagagcccccaaacctgtgcccatgcccctccagccctgcgtttccattctgccttctcagagtgcccttgctgcacccagaccaccggccaggagagaccttctctcccactccagcccctctcactgcccttcaactagagctttcacctttttacatttcccttctgaaggacacaaatctgcttttctgcccatacactggcccaagggctcacctaacttgggagggaaggggctgttggtacaaggatgattttctgttaggctgccattttgcacggtctccccctccccatctgatgtgtcctgcccctcagctctttgccttatctgtgtcactgtcactttagcaaaaatacagcggccatttgtatcaaaaaaaaaaaaaaaaaaaaaaaa

SEQ ID NO: 568 - DNA, 4604 bp, Homo sapiens
ggaacagcttgtccacccgccggccggaccagaagcctttgggtctgaagtgtctgtgagacctcacagaagagcacccctgggctccacttacctgccccctgctccttcagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccggcctccagttcgtgtgaatgatggtggagggagccatccttccaggcccaactccagacacactcccagcttctctggggactcctcctcctcctgctcagatcactgtatcacctcttcagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggattcagagacctcacctctgaggaccagatcgtactgctgaagtcaagtgccattgaggtcatcatgttgcgctccaatgagtccttcaccatggacgacatgtcctggacctgtggcaaccaagactacaagtaccgcgtcagtgacgtgaccaaagccggacacagcctggagctgattgagcccctcatcaagttccaggtgggactgaagaagctgaacttgcatgaggaggagcatgtcctgctcatggccatctgcatcgtctccccagatcgtcctggggtgcaggacgccgcgctgattgaggccatccaggaccgcctgtccaacacactgcagacgtacatccgctgccgccacccgcccccgggcagccacctgctctatgccaagatgatccagaagctagccgacctgcgcagcctcaatgaggagcactccaagcagtaccgctgcctctccttccagcctgagtgcagcatgaagctaacgccccttgtgctcgaagtgtttggcaatgagatctcctgactaggacagcctgtgcggtgcctgggtggggctgctcctccagggccacgtgccaggcccggggctggcggctactcagcagccctcctcacccgtctggggttcagcccctcctctgccacctcccctatccacccagcccattctctctcctgtccaacctaacccctttcctgcgggcttttccccggtcccttgagacctcagccatgaggagttgctgtttgtttgacaaagaaacccaagtgggggcagagggcagaggctggaggcaggccttgcccagagatgcctccaccgctgcctaagtggctgctgactgatgttgagggaacagacaggagaaatgcatccattcctcagggacagagacacctgcacctccccccactgcaggccccgcttgtccagcgcctagtggggtctccctctcctgccttactcacgataaataatcggcccacagctcccaccccacccccttcagtgcccaccaacatcccattgccctggttatattctcacgggcagtagctgtggtgaggtgggttttcttcccatcactggagcaccaggcacgaacccacctgctgagagacccaaggaggaaaaacagacaaaaacagcctcacagaagaatatgacagctgtccctgtcaccaagctcacagttcctcgccctgggtctaaggggttggttgaggtggaagccctccttccacggatccatgtagcaggactgaattgtccccagtttgcagaaaagcacctgccgacctcgtcctccccctgccagtgccttacctcctgcccaggagagccagccctccctgtcctcctcggatcaccgagagtagccgagagcctgctcccccaccccctccccaggggagagggtctggagaagcagtgagccgcatcttctccatctggcagggtgggatggaggagaagaattttcagaccccagcggctgagtcatgatctccctgccgcctcaatgtggttgcaaggccgctgttcaccacagggctaagagctaggctgccgcaccccagagtgtgggaagggagagcggggcagtctcgggtggctagtcagagagagtgtttgggggttccgtgatgtagggtaaggtgccttcttattctcactccaccacccaaaagtcaaaaggtgcctgtgaggcaggggcggagtgatacaacttcaagtgcatgctctctgcaggtcgagcccagcccagctggtgggaagcgtctgtccgtttactccaaggtgggtctttgtgagagtgagctgtaggtgtgcgggaccggtacagaaaggcgttcttcgaggtggatcacagaggcttcttcagatcaatgcttgagtttggaatcggccgcattccctgagtcaccaggaatgttaaagtcagtgggaacgtgactgccccaactcctggaagctgtgtccttgcacctgcatccgtagttccctgaaaacccagagaggaatcagacttcacactgcaagagccttggtgtccacctggccccatgtctctcagaattcttcaggtggaaaaacatctgaaagccacgttccttactgcagaatagcatatatatcgcttaatcttaaatttattagatatgagttgttttcagactcagactccatttgtattatagtctaatatacagggtagcaggtaccactgatttggagatatttatggggggagaacttacattgtgaaacttctgtacattaattattattgctgttgttattttacaagggtctagggagagacccttgtttgattttagctgcagaactgtattggtccagcttgctcttcagtgggagaaaaacacttgtaagttgctaaacgagtcaatcccctcattcaggaaaactgacagaggagggcgtgactcacccaagccatatataactagctagaagtgggccaggacaggccgggcgcggtggctcacgcctgtaatcccagcagtttgggaggtcgaggtaggtggatcacctgaggtcgggagttcgagaccaacctgaccaacatggagaaaccctgtctctattaaaaatacaaaaaaaaaaaaaaaaaaaaatagccgggcatggtggcgcaagcctgtaatcccagctactcaggaggctgaggcagaagaattgaacccaggaggtggaggttgcagtgagctgagatcgtgccgttactctccaacctggacaacaagagcgaaactccgtcttagaagtggaccaggacaggaccagattttggagtcatggtccggtgtccttttcactacaccatgtttgagctcagacccccactctcattccccaggtggctgacccagtccctgggggaagccctggatttcagaaagagccaagtctggatctgggaccctttccttccttccctggcttgtaactccaccaagcccatcagaaggagaaggaaggagactcacctctgcctcaatgtgaatcagaccctaccccaccacgatgtgccctggctgctgggctctccacctcaggccttggataatgctgttgcctcatctataacatgcatttgtctttgtaatgtcaccaccttcccagctctccctctggccctgcttcttcggggaactcctgaaatatcagttactcagccctgggccccaccacctaggccactcctccaaaggaagtctaggagctgggaggaaaagaaaagaggggaaaatgagtttttatggggctgaacggggagaaaaggtcatcatcgattctactttagaatgagagtgtgaaatagacatttgtaaatgtaaaacttttaaggtatatcattataactgaaggagaaggtgccccaaaatgcaagattttccacaagattcccagagacaggaaaatcctctggctggctaactggaagcatgtaggagaatccaagcgaggtcaacagagaaggcaggaatgtgtggcagatttagtgaaagctagagatatggcagcgaaaggatgtaaacagtgcctgctgaatgatttccaaagagaaaaaaagtttgccagaagtttgtcaagtcaaccaatgtagaaagctttgcttatggtaataaaaatggctcatacttatatagcacttactttgtttgcaagtactgctgtaaataaatgctttatgcaaacc

SEQ ID NO: 569 - DNA, 1901 bp, Homo sapiens
agtgcggcgcagcgcagctcctgaggttttggttatgaacaggattcggattcacgtcttgccaaccaatcgggggaggatcactccagtgcccaggtctcaggaacctctgtcttgtgcattcactcatcgtccatgctctcaccctcgtctggaggggcaggagttttgcattaagcatatccttgaagacaagaatgcacccttcaagcagtgtagttatatatcgacgaagaatggaaaaagatgtcccaatgctgccccaaagccagagaagaaagatggggtgtccttctgtgctgaacatgtccgtaggaatgccctggcacttcatgctcaaatgaagaagaccaacctagggcctgtgggtgaaacactcctgtgccagctgagctcatatgctaagacagagctggggtctcagactccagaaagtagtcgcagtgaagccagccgaatactagacatgctggtgtctacacagcagaagaagtggccctgattatgcgtgaaaagctaattcgtttgcagtcgttgtatattgatcagtttaaacgacttcagcatctgctcaaggagaagaagcgccgatacttacataatcgcaaagtggaacatgaagctctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggcccataccactcgttccagtcagaggtgcttggcctttgtggatgatgttcgttgttccaatcagtctcttccaatgaccagacactgccttacccagaaagatgcgactgccattggtgacctgttaactctttactgtggtctaatggagacagcactcgactgaaagtgaaggacccagactctagttgacttggatgttgtgggtgatggtatgcagtgtcctccttcacctttgctttttgatccttcactaacccttgaagatcatttagtcaaagaaattgctgaagacacagtggatattttgggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatccctatcaaagcttctgggatcatttgggactatacctaaaaggaaagtgacatctttgtaatgggatttcccaagtcatggatagaaatccacttaagtagctaggtgggagctgtctttgtgagtggtgtctttgagatactgatggccctaatatcggttatctctatctgaagacctgcagtttagcttttcttcacctctacttaattgggcagtctttaacccctttccctggtgaactctggctttttatcctctgagaaaacagcccacaggactgggtcctccttatccgtcttgcttttaacctatgtaaatttctgtggttgctatcttatgtaaaatatagtaaaaatttattgtatatagtttctattaaatgttaaagaaaatgttatgaaaatatcaaacagtcacctgaattgaatgcaaaaaaaaaaaaaaaaaaaa

SEQ ID NO: 570 - DNA, 2714 bp, Homo sapiens
gggtggggggagcggtgatctgagctccgagcagctggtcttcgcggctcgctccctccttcgcgctctctcgctccctgccgccgcccgcagggctgcggggctcggtggcatctcccgggcgcggcccgcagtccttgcccctgcctccgggccgctcccgcccccggcgccgctcgctcccccgacccggactcccccatgtatgacgactcctacgtgcccgggtttgaggactcggaggcgggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatctgtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtcaaaaaaaaaaaaaaaa

SEQ ID NO: 571 - DNA, 2714 bp, Homo sapiens; identical to SEQ ID NO: 570

SEQ ID NO: 572 - DNA, 3288 bp, Homo sapiens
ggggggtgttcatctccgcgaccaggaaacgggaaagatggcgacggctccgcgacgttgaggccgcgttgggcggttcagactcagggtgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttggaagatcctcaggaacgggaacgtcgggaacgcagggagaggatggaacgggagaccaatggaaatgaggatgaggaagggcggcagaagatccgggaagagaaggataagagcaaggaactgcatgccattaaggagcgttacctgggtggcatcaaaaagcggcgccgaacgagacatctcaatgaccggaaatttgtttttgagtgggatgcatctgaggacacatccattgactacaaccccctgtacaaagaacggcaccaggtgcagttgttagggcgaggcttcattgcaggcattgacctcaagcagcagaagcgagagcagtcacgtttctatggagacctaatggagaagaggcgaaccctggaagaaaaggagcaggaggaggcaagactccgcaaacttcgtaagaaggaagccaagcagcgctgggatgatcgtcattggtctcagaaaaagttagatgagatgacggacagggactggcggatcttccgtgaggactacagcatcaccaccaaaggtggcaagatccccaatcccatccgatcctggaaagactcttctctgcccccacacatcttggaggtcattgataagtgtggctacaaggaaccaacacctatacagcgtcaggcaattcccattgggctacagaatcgtgacatcattggtgtggctgagactggcagtggcaagacagcagccttcctcatccctctgctggtctggatcaccacacttcccaaaattgacaggatcgaagagtcagaccaaggcccttatgccatcatcctggctcccacccgtgagttggctcaacagattgaggaagagaccatcaagtttgggaaaccgctaggtatccgcactgtggctgtcattggtggcatctccagagaagaccagggcttcaggctgcgcatgggttgtgagattgtgattgctacccctgggcgtttgattgatgtgctggagaaccgctacctggtgctgagccgctgtacctatgtggttctggatgaggcagataggatgattgacatgggctttgagccagatgtccagaagatcctggagcacatgcctgtcagcaaccagaagccagacacggatgaggctgaggaccctgagaagatgctggccaactttgagtcgggaaaacataagtaccgccaaacagtcatgttcacggccaccatgcccccagcggtggagcgtctggccaggagctatcttcggcgacctgctgtggtgtacattggctccgcaggcaagccccatgagcgtgtggaacagaaggtcttcctcatgtcagagtcagaaaagaggaaaaagctgctggcaatcttggagcaaggctttgacccacccatcattatttttgtcaaccagaagaagggctgcgacgtgttggccaaatccctggagaagatggggtacaatgcttgcacactgcacggtggaaaaggccaggagcagcgagagtttgcgttgtccaacctcaaggctggggccaaggatattttggtggctacagatgtggctggtcgtggtattgacatccaagatgtgtctatggttgtcaactatgatatggccaaaaatattgaagattacatccaccgcattggccgcacgggacgagcaggcaagagtggggtggccatcaccttcctcacaaaagaggactctgctgtgttctacgagctgaagcaagctatcctggaaagcccagtgtcttcctgtccccccgaactagccaaccacccagatgcccagcataagccaggcaccatcctcaccaagaagcgccgggaagagaccatctttgcctgacacagcactcttcctgtgggctgagggcatctccaaagctgcctgatgcctgtttttcagaaccctcacatccctctttccaggtcctcactcttgggatatgggggcttaggaaaacaatccaactccctagcccagaccctcaggtcaggaggcctgcgtgtggggctgcaaaaggagaggacgacgctgtcggaggcagggagagcaaattaccacagcttcttggcccagttctgcccttctttgctttgggattgcactgggccatcagctcatgccaggctatgggggcagccagttggcattgctccccagactgaacagaaacctggccgccggatgggacctcctttggcacagacttgactgtgtaactgcataaactgcagtagcatcattgccctagatgccccaggagacctggcaccatgaggattacagacagtggaatcttactgtcatctggacagctgttttcctgtttggatggtaaaggaagttgagagtctttagacctgtgcacagccccgcaccaaggggtgctgtatgctctaggcatcccctcccccaggggattttctaagtagatggggggacacggtgaactggctgtgtccatctttgtcactgagtgaaatctctgttttctattctctgagaagataagtttgtatgttctgagaataaatacatgaatattaagactgttaaaaaaaaaaaaaaaaaaaaaa

SEQ ID NO: 573 - DNA, 727 bp, Homo sapiens
gaacgagggtcctagctgccgccacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaacttaaaaaaaaaaaaaaaaaaaaaaaaa

SEQ ID NO: 574 - DNA, 3595 bp, Homo sapiens
ggaggtgggaagtatcccgggctgggggtgggggtacgccgcacagctccagtcgccgtcgcggcttccggtgctaggtggagggaaggaaggagggagccggggagtgggccagggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgcctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 575 - DNA, 3595 bp, Homo sapiens; identical to SEQ ID NO: 574

SEQ ID NO: 576 - DNA, 1698 bp, Homo sapiens
gcggggcctgccccaagagagtttcctaaagcgaggaaaccaagccgggcgcctcttgcaatggagacggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacgataaaaaaaaaaaaaaaa

SEQ ID NO: 577 - DNA, 2328 bp, Homo sapiens
gtttctgtcgcaggctgcgaggaaaggcccctaggctgggtctgggtgcttggcggcggcggcttcctccccgctcgtcctccccgggcccagaggcacctcggcttcagtcatgctgagcagagtatggaagcacctgactacgaagtgctatccgtgcgagaacagctattccacgagaggatccgcgagtgtattatatcaacacttctgtttgcaacactgtacatcctctgccacatcttcctgacccgcttcaagaagcctgctgagttcaccacagtttcatcctacaaaatgggcgtaacaatgtctacctactccattgtgtggaccaaaggagatggttaatgtgaaagccctttgtgaacctgaagtgagcaactgctggatgaatgtcattacgggcacaggctctgtgtcatctcctctcctagtgcttccacagccaggaccagagacctccctgatgactggggaacctgtggatgatgaagatgccaccgtcaacaagattgcgctcgagctgtgcacctttaccctggcaattgccctgggtgctgtcctgctcctgcccttctccatcatcagcaatgaggtgctgctctccctgcctcggaactactacatccagtggctcaacggctccctcatccatggcctctggaaccttgtttttctcttctccaacctgtccctcatcttcctcatgccctttgcatatttcttcactgagtctgagggctttgctggctccagaaagggtgtcctgggccgggtctatgagacagtggtgacgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgagtcatgcagggtacctccttaggccaggtctccttctccaagctgggctcctttggtgccgtcattcaggttgtactcatcttttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaacgcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgttttttt

SEQ ID NO: 578 - DNA, 2996 bp, Homo sapiens
aaaactcttctcagacccgggagcgtccgggacgcggagcccggagctggggcgacgaggcgattgcgggggcctgggctagctgctggctaccaatattctactttctgtctctatgtatgtgactaccctggttacctcatataatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgtttcccacttttaaatcagagatacctacactcaaaacccagacaaggcaaaaggatacctttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctgccgcagaaccaagtaacggcatcccagattccagtaaatcagtttccattcaagaggaacagtctgcgccttcctcagagaaaggtggtatgaatggctaccatgtcaatggtgccatcaatgacactgagtctgtggactcactcagtgaaggtttggagacactttcaatagatgccagagaattggaggatcccgagtctgccatgctagatacgctggacagaacaggatccatgctgcagaatggtgtctctgattttgagaccaagtctttgactatgcactctattcacaattctcaacaacccaggaatgctgccaaatctctctcaagacctaccacagaaactcagttttcaaatatggggatggaagatgttcccctcgccaccagtaaaaagctaagttccaatattgaaaaatctgtaaaagacctccagcgctgcacagtgtctcttgcacggtatcgagttgtagttaaagaagagatggatgcctccattaagaaaatgaaacaagcctttgctgaattggagagctgtttaatggatcgagaagtggcgttgcttgctgaaatggacaaagtgaaagctgaagcaatggaaattttgctcagccgacaaaagaaggctgaacttctaaagaagatgactcatgtggctgttcaaatgtcagagcagcaattggttgagctcagagctgatatcaagcactttgttagtgaacgtaaatatgatgaggatctgggacgagtagcccggttcacctgtgatgtagagaccctaaagaagagcattgattcatttggacaagtgtctcatccaaagaacagctattcgaccagatcccgatgtagctcagttacatctgtgtccttgagtagcccaagtgatgcctctgctgcttcctcttccacctgtgcctctcctcccagccttacaagtgctaacaagaaaaactttgcaccgggagagactcctgcagccatagcaaactccagtggccagccctaccagccacttcgggaggtattgccagggaacagacgaggaggacagggctataggccacaaggccaaaagtccaatgaccccatgaaccaagggcggcatgacagtatgggtcgttacagaaacagctcgtggtattcatctggttccaggtatcagagtgctccatctcaggcaccaggaaacaccattgaaagaggccagactcactctgcagggaccaatggaactagagtcagcatggagcccagccctcccacgccttcattcaaaaaggggctcccccagcgcaaacccaggacctctcagactgaagccgtgaactcttgagagaaaatccagttggcctctctcctctatccacacaattcaacttgataactggactttaggaaacttacagttagatgtaataacaaaaagaagtttatgcgtatcactttttgtgccattctaagtatttttggttcttgtctccttatttcctctttaccatttttggaggggaagctattttttttccttgatctttcccagtgatatggattgaatctggttggtcatttccaccaggaatcagaggcagctgttaccaggtttcggccttccagttgatccctccactgtccaggctgtctcaggaggaggtgaatcagagctagtctgtcacctttccaatctaagccgaagccacaggtgcctgacaggttcccttctaacaactatttgaccaagagaggcaatcagggggttgtatactgcactggattcgccagagaagggaaaatttaattagtgaagaggaaagaacactaggaaacatttgagaacctgcctctatcccagaacgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttgtggctcatgcctgtaatcccagcactttgggaggctgaggcgggtggatcactaggtcaggagttcaagaccagcctggccaacatggtgaaaccctgtctgtactaaaaatacaaaagttagctgagcatggtggcgtgtgcctgtaatctcagctactcaggaggctgaggcaggagaatcgcttgaacccaggaggcggaggctgcagtgagctgagattgtgccactgcactccagcctgggagacagagcaagactcagtctc

SEQ ID NO: 579 - DNA, 1937 bp, Homo sapiens
gtacctcacggaagccggctttggccctgcggctgctaccgtcgccgcggagaaattgttggatctggcagtctaggaatgaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggttcatcaagaggaagaagttcgatgatgagctggtggagagcagcctggcaaaatcttctacccgggcaaagggggccagtggggtggaaccagggcgctgttcggggagtgaaccctcctccagtgagaagaagaaggtatccaaagcccccagcactcctgtgccacccagcccagccccagcccctggactcaccaagcgtgtgaagaagagtaaacagccacttcaggtgaccaaggatctgggccgctggaagcctgcagatgacctcctgctcataaatgctgtgttgcagaccaacgacctgacctccgtccacctgggcgtgaaattcagctgccgcttcacccttcgggaggtccaggagcgttggtacgccctgctctacgatcctgtcatctccaagttggcctgtcaggccatgaggcagctgcacccagaggctattgcagccatccagagcaaggccctgtttagcaaggctgaggagcagctgctgagcaaagtgggatcgaccagccagcccaccttggagaccttccaggacctgctgcacagacaccctgatgccttctacctggcccgtaccgcgaaggccctgcaggcccactggcagctcatgaagcagtattacctgctggaggaccagacagtgcagccgctgcccaaaggggaccaagtgctgaacttctctgatgcagaggacctgattgatgacagtaagctcaaggacatgcgagatgaggtcctggaacatgagctgatggtggctgaccggcgccagaagcgagagattcggcagctggaacaggaactgcataagtggcaggtgctagtggacagcatcacaggcatgagctctccggacttcgacaaccagacactggcagtgctgcggggccgcatggtgcggtacctgatgcgctcgcgtgagatcaccctgggcagagcaaccaaggataaccagattgatgtggacctgtctctggagggtccggcctggaagatatcccggaaacaaggtgtcatcaagctgaagaacaacggtgatttcttcattgccaatgagggtcgacggcccatctacatcgatggacggccggtgctctgtggctccaaatggcgcctcagcaacaactctgtggtggagatcgccagcctgcgattcgtcttccttatcaaccaggacctcattgccctcatcagggctgaggctgccaagatcacaccacagtgaggagtggtggcaggactcgtgggccctctccggcctgtttcccctgccactccagcccccttgagctgggaactcaggctcctggaaaaacctgggcagtgggaggctcagctgcgggccattgatttgagcctttgagggaggatagggctggcctttgtgaagccagcagaggctgagaacctcaggcttccctagatccagagcccctccccatcttcctctctctaaaaacaaccctaccccccattgccaccttcactcctgtgtctccagctgattagcctcagactcttcttttattgtttttcttttgtaaataaaaagcaccaggttccaaaaaaaaaaaaaaaaaaa

SEQ ID NO: 580 - DNA, 2600 bp, Homo sapiens
ggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacagcaatgatctttacctgcttcaccctcagtgcactctatgccaggcgccgtagctacctctttctgggaggtatcttgatgtcagccctgagcttgttgcttttgtcttccctggggaatgttttctttggatccatttggcctttccaggcaaacctgtatgtgggactggtggtcatgtgtggcttcgtccttgttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagccagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccgccccttgcctgaccctcagggagtcagcctgcttccatccatgggtgggaagacttcagcacaaaggaaagactaattcttgtcaggcatttttgaaaaggctgattatgtgtatcaaggtacagctacgtaggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaaaaaaaaaaaaaaaaaaaaaaaa

SEQ ID NO: 581 - DNA, 3237 bp, Homo sapiens
gcgaagtgaagggtggcccaggtggggccaggctgactgaatgtatctcctagctatggactaaataatacatggggggaaataaacaagtattcatgagggtgaaaatgtgacccagcaggaaaattacaactattttcaattgacgttgaataggatgagtcatggaatttaagtgatttactgaagattatactactggtagatagaagagctaaagaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgccgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatgaaaaaaaaaa

SEQ ID NO: 582 - DNA, 4103 bp, Homo sapiens
ggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccgttgcaaagcacactgtctttctcagcgttctctgcaagtcagtaggtgttagtatggttgcaaagttcactgtctcagcaaagttgaactgggctacctctctacagctgtttcctcagagggaaaaatcttgagaccatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttcc

SEQ ID NO: 583 - DNA, 2393 bp, Homo sapiens
gagagagcgagacctgggagggaggggtcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctagtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcataaaaaaaaaaaaaaaaaaaaaaa

SEQ ID NO: 584 - DNA, 1916 bp, Homo sapiens
cgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctttgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatcccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaataaagtgatgaagttgcattaaaaaaaaaaaaaaaaaaa

SEQ ID NO: 585 - DNA, 1076 bp, Homo sapiens
gccacctcggccgtggcaggaaccgaaacccggagcggccgaagctcagcgctccgctggggcagagggtcgcggcggctgggaacgccgctccccgacgcaccggccgcccccagcgcagcgcgctccgcggggtgctgatctgcctcttctccaagaaactcaaccactagtgacaatgaccagcctcctgactactccttctccaagagaagaactgatgaccaccccaattttacagcccactgaggccctgtccccagaagatggagccagcacagcactcattgcagttgttatcaccgttgtcttccttaccctgctctcggtcgtgatcttgatcttcttttacctgtacaagaacaaaggcagctacgtcacctatgaacctacagaaggtgagcccagtgccatcgtccagatggagagtgacttggccaagggcagcgagaaagaggaatatttcatctaatgactcccaggccccaaggagcttattcctggctccatcgctaacacgttgactgcttattatgggaaagttttctctgaagccagggagaagcattgattgatgtgggcaaatccaagctccagccaggtcgcagtcccaaatgccgacatcactgactccagggaccagggacatggagaaagctgtttatgatatctttaaccaggccctcttactagagctggtgtttgtgactggccaacaagatgtggctatgccaggggacatctgagtatgtgcccagtcatcttttttcacaggttgaagggagagaaaagattttgagttaaggtcattggctgctctactctgtcccctacctggtcacctagtgatagccccagtggagatactgtccatacaaggtcttcccagaggctggataccacagtaaaaggccaggccaggaggggtaggagactatggagatcttacctcctgataaatgtgctacaccccctaatctgagcccttcctttccgtgttccccaacaacctcatgcttacgtgatttttattcaaattaaaaattttcattgctacaaaaaaaaaaaaaaaaaaa

SEQ ID NO: 586 - DNA, 952 bp, Homo sapiens
ttggtccaagcaagaaggcagtggtctactccatcggcaacatgctggtcctttatggacacagcacccaggaccttccggaaaccaatgcccgcgtagtcggagggactgaggccgggaggaattcctggccctctcagatttccctccagtaccggtctggaggttcccggtatcacacctgtggagggacccttatcagacagaactgggtgatgacagctgctcactgcgtggattaccagaagactttccgcgtggtggctggagaccataacctgagccagaatgatggcactgagcagtacgtgagtgtgcagaagatcgtggtgcatccatactggaacagcgataacgtggctgccggctatgacatcgccctgctgcgcctggcccagagcgttaccctcaatagctatgtccagctgggtgttctgccccaggagggagccatcctggctaacaacagtccctgctacatcacaggctggggcaagaccaagaccaatgggcagctggcccagaccctgcagcaggcttacctgccctctgtggactatgccatctgctccagctcctcctactggggctccactgtgaagaacaccatggtgtgtgctggtggagatggagttcgctctggatgccagggtgactctgggggccccctccattgcttggtgaatggcaagtattctctccatggagtgaccagctttgtgtccagccggggctgtaatgtctccaggaagcctacagtcttcacccaggtctctgcttacatctcctggataaataatgtcatcgcctccaactgaacattttcctgagtccaacgaccttcccaaaatggttcttagatctgcaataggacttgcgatcaaaaagtaaaacacattctgaaagactattgagccattgatagaaaagcaaataaaactagatatacatt

SEQ ID NO: 587 - DNA, 4540 bp, Homo sapiens
cgctgctgggctgcggcggcggcggcggcggcggtggttactatggcggagtcggccggagcctcctccttcttcccccttgttgtcctcctgctcgccggcagcggcgggtccgggccccggggggtccaggctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggcactgcgggtgatggggaagatgatgcgagagtgttggtatgccaacggcgcagcccgcctgacggccctgcgcatcaagaagaccctctcccagctcagcgtgcaggaagacgtgaagatctaactgctccctctctccacacggagctcctggcagcgagaactacgcacagctgccgcgttgagcgtacgatggaggcctacctctcgtttctgcccagccctctgtggccaggagccctggcccgcaagagggacagagcccgggagagactcgctcactcccatgttgggtttgagacagacaccttttctatttacctcctaatggcatggagactctgagagcgaattgtgtggagaactcagtgccacacctcgaactggttgtagtgggaagtcccgcgaaacccggtgcatctggcacgtggccaggagccatgacaggggcgcttgggaggggccggaggaaccgaggtgttgccagtgctaagctgccctgagggtttccttcggggaccagcccacagcacaccaaggtggcccggaagaaccagaagtgcagcccctctcacaggcagctctgagccgcgctttcccctcctccctgggatggacgctgccgggagactgccagtggagacggaatctgccgctttgtctgtccagccgtgtgtgcatgtgccgaggtgcgtcccccgttgtgcctggttcgtgccatgcccttacacgtgcgtgtgagtgtgtgtgtgtgtctgtaggtgcgcacttacctgcttgagctttctgtgcatgtgcaggtcgggggtgtggtcgtcatgctgtccgtgcttgctggtgcctcttttcagtagtgagcagcatctagtttccctggtgcccttccctggaggtctctccctcccccagagcccctcatgccacagtggtactctgtgtctggcaggctactctgcccaccccagcatcagcacagctctcctcctccatctcagactgtggaaccaaagctggcccagttgtccatgacaaaagaggcttttgggccaaaatgtgagggtggtgggtgggatgggcagggaaggaatcctggtggaagtcttgggtgttagtgtcagccgtgggaaatgagccagcccaagggcatcatcctcagcagcatcgaggaagggccgaggaatgtgaagccagatctcgggactcagattggaatgttacatctgtctttcatctcccagatcctggaaacagcagtgtatatttttggtggtggtgggtttggggtggggaagggaagggcgggcaaggagtggggagggagtctggggtgggagggaggcatctgcatgggtcttcttttactggactgtctgatcagggtggagggaaggtgagaggtttgcatccacttcaggagccctactgaagggaacagcctgagccgaacatgttatttaacctgagtatagtatttaacgaagcctagaagcacggctgtgggtggtgatttggtcagcatatcttaggtatataataactttgaagccataacttttaactggagtggtttgatttctttttttaattttattgggagggtttggattttaactttttttaatgttgttaaatattaagtttttgtaaaaggaaaaccatctctgtgattacctctcaatctatttgtttttaaagaaatccctaaaaaaaaaaattatccaattgaacgcacatagctcaatcacactggaaatgtttgtcgttgcacctgagcctgttcccactcagcagtgagagttcctctttgccctgaggctcagtctctctcgtattttgtccccacccccaattccttgagtggtttttgctctagggccctttcttgcactgtccagctggttgtaccctctccaggcatttattcaacaaatgtgggtgaagtgcctgctgggtgccaggtgctgggaatacatctgtggacaagacatgcttgggtcctactcctggagcactgtaaaaagagctgattcaagtaagtagatgcctgttttgagaccagaaggtttcataattggttctacgacccttttgagcctagaattattgttcttatataagatcactgaagaaagaggaacccccacaaccccctccacaaagagaccaggggcgggtgatgagacctggggtttagaaccccaggtgagacctcaaatcactgcattcattctgagcccccttcctgtccccaggggaggtgtattgtgtatgtagccttagagcatctctgcctccaacccagcagttctctgccaaagcttgtggaggagggagagccctgtccctgccctcaggctccccagtgctcctggcccttctatttatttgactgattattgcttctttccttgcattaaaggagatcttcccctaacctttgggccaatttactggccactaatttcgtttaaataccattgtgtcattggggggaccgtctttacccctgctgacctcccacctatccgccctgcagcagaaccttggcggtttataggtaatgatggaacttagactcctcttcccagagtcacaagtagcctctgggatctgccaacacacgtccactcccaagccactagcccactccccagttggcccttctgcccttaccccacacacagtccaactcttccacctctggggaagatggagcaggtctttgggaagctcccacacccacctctgccactcttaacactaagtgagagttggggagaaactgaagccgtgtttttggccccccgaggctaaccctgatccatagtgctacctgcacctctggattctggattcacagaccaagtccaagcccgttcttacgtcgccataaaggcccccgaacggcattctcggtacttctgtttgtttttgtacattttattagaaaggactgtaaaatagccacttagacactttacctcttcagtatgcaaatgtaaataaattgtaatataggaaatcttttgttttaatataagaatgagcctgtccaatttctgctgtacattattaaaagttttattcacaaaaaaaaaaaaaaa

SEQ ID NO: 588 - DNA, 1783 bp, Homo sapiens
cgctgctgggctgcggcggcggcggcggcggcggtggttactatggcggagtcggccggagcctcctccttcttcccccttgttgtcctcctgctcgccggcagcggcgggtccgggccccggggggtccaggctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggtaagaagctggcctcctgctgctttcccatcagcctgatttctccaccttagaaaagggtttcttgacaatggggtcaggccccagaggagccccctgagagtgtcagttattatttactattacgtgctattttacatatcccaagccctttagggctacagtctcttgtcctggaccctgtagggtgccatttggagttcacagcctagaagaagaaaaggctttgggcctggtgtggtggcataggcctgtaatcgtagcgctttgagaggctgaggcaggaagatagcttgagctcaggagttcgagacaaacctgggcaatgtggggagaccccatctctaca

SEQ ID NO: 589 - DNA, 1708 bp, Homo sapiens
cgctgctgggctgcggcggcggcggcggcggcggtggttactatggcggagtcggccggagcctcctccttcttcccccttgttgtcctcctgctcgccggcagcggcgggtccgggccccggggggtccaggctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggtacctttcttttttgcctttgctcctacctcccattccaggatgctggatcacccaaagctgttttactgccccctttctttttacaacctgttggatgcctgttgccagagcctgaatcatcgtttaaggttgccatcaaaggtgtggaggtagctgtgcttagggtgcgtttattcttcagggatcagtttgttgaatagcgttgtgtgttatggtaaccattctgaaggctcgtttggctttataaacaaacaaacattgttttattagtccgtggcggggagtgccccggtgcgcatagcacgggattcatgcagtggtctccttcacatcagaagcagtatattctaacgcggtggctcccaagccacattcatgggaaaccctgctgtttcattgtta

SEQ ID NO: 590 - DNA, 4540 bp, Homo sapiens; identical to SEQ ID NO: 587

SEQ ID NO: 591 - DNA, 1783 bp, Homo sapiens; identical to SEQ ID NO: 588

SEQ ID NO: 592 - DNA, 1708 bp, Homo sapiens; identical to SEQ ID NO: 589

SEQ ID NO: 593 - DNA, 1836 bp, Homo sapiens
atggcggcctcagcaaaaaagaagaataagaaggggaagactatctccctaacagactttctggctgaggatgggggtactggtggaggaagcacctatgtttccaaaccagtcagctgggctgatgaaacggatgacctggaaggagatgtttcgaccacttggcacagtaacgatgacgatgtgtatagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttgaaaggttttggttatgctgaatttgaggacctggattccctgctcagtgccctgagtctcaatgaagagtctctaggtaacaggagaattcgagtggacgttgctgatcaagcacaggataaagacagggatgatcgttcttttggccgtgatagaaatcgggattctgacaaaacagatacagactggagggctcgtcctgctacagacagctttgatgactacccacctagaagaggtgatgatagctttggagacaagtatcgagatcgttatgattcagaccggtatcgggatgggtatcgggatgggtatcgggatggcccacgccgggatatggatcgatatggtggccgggatcgctatgatgaccgaggcagcagagactatgatagaggctatgattcccggataggcagtggcagaagagcatttggcagtgggtatcgcagggatgatgactacagaggaggcggggaccgctatgaagaccgatatgacagacgggatgatcggtcgtggagctccagagatgattactctcgggatgattataggcgtgatgatagaggtcccccccaaagacccaaactgaatctaaagcctcggagtactcctgaagaagatgattcctctgctagtacctcccagtccactcgagctgcttctatctttggaggggcaaagcctgttgacacagctgctagagaaagagaagtagaagaacggctacagaaggaacaagagaagttgcagcgtcagtggaatgagccaaaactagaacgacggcctcgggagagacacccaagctggcgaagtgaagaaactcaggaacgggaacggtcgaggacaggaagtgagtcatcacaaactgggacctccaccacatctagcagaaatgcacgaaggagagagagtgagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacacagagcagcagtcccctacaagtggtgggggaaaagtagctccagctcaaccatctgaggaaggaccaggaaggaaagatgaaaataaagtagatgggatgaatgccccaaaaggccaaactgggaactctagccgtggtccaggagacggagggaacagagaccactggaaggagtcagataggaaagatggcaaaaaggatcaagactccagatctgcacctgagccaaagaaacctgaggaaaatccagcttctaagttcagttctgcaagcaagtatgctgctctctctgttgatggtgaagatgaaaatgagggagaagattatgccgaatag

SEQ ID NO: 594 - DNA, 2900 bp, Homo sapiens
gcagagtcagtgtgcggtttgggagaaaatgtgtcggatattttggggcggtcacgtgggcgggcgggctccgagaggccccgggacagtcccagcctagagccgtgcccccccaggagccccccagtacggcgagccccggacattgcgacgctccatccaagagactgcccgacgccgggacctcggggctccgccgcctcccttccccctcccactccagctacggcccagttccctcaacctgacccagtatgtagaagccagtctctgcaggcggccagcgggacttttggaggcccagtgggcaggccaggcagggcgggtacggagcctcccaggctggggcagtgggcatgggcaggggctgtggctgaagacctcgcccgcccactgcagactccaggggactctcacaccgcagctgccatggccaccaataaggagcgactctttgcggctggtgccctggggcctggatctggctacccaggggcaggtttccccttcgccttcccaggggcactcagggggtctccgcctttcgagatgctgagccctagcttccggggcctgggccagcctgacctccccaaggagatggcctctctgtcggtggagacacagagcaccagctcagaggagatggtgcccagctcgccctcgccccctccgcctcctcgggtctacaagccatgcttcgtgtgcaatgacaagtcctctggctaccactatggggtcagctcttgtgaaggctgcaagggcttctttcgccgaagcatccagaagaacatggtgtacacgtgtcaccgcgacaaaaactgtatcatcaacaaggtgaccaggaatcgctgccagtactgccggctacagaagtgcttcgaagtgggcatgtccaaggaagctgtgcgaaatgaccggaacaagaagaagaaagaggtgaaggaagaagggtcacctgacagctatgagctgagccctcagttagaagagctcatcaccaaggtcagcaaagcccatcaggagactttcccctcgctctgccagctgggcaagtataccacgaactccagtgcagaccaccgcgtgcagctggatctggggctgtgggacaagttcagtgagctggctaccaagtgcatcatcaagatcgtggagtttgccaagcggttgcctggctttacagggctcagcattgctgaccagatcactctgctcaaagctgcctgcctagatatcctgatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggagaccgcatggacctggaggagcccgaaaaagtggacaagctgcaggagccactgctggaagccctgaggctgtacgcccggcgccggcggcccagccagccctacatgttcccaaggatgctaatgaaaatcaccgacctccggggcatcagcactaagggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccatgggtcctagacttcccagggcaagaggaagaccctgccattccacagccccttcctctgccaggtgcttggctctctgagagcaaacaggaacactagagaccaaaaaggggacaaaggagaagggctgagcccaccttcttgctcctacccttggtgcctaatgctgtgtgatgcacctgcagggtgtgtgctagcctctgtgccccgtccttgtgccaggtcaaggtgggggcaggctgggccctgcatttctggggcaggaacagagggtgaaagggacagatagatgcaggtccattctgcacctcttggctcgggtgcagagttcaccctgtgccctccgttataagtccctcccccagccctgtcatgtgccttgggctcctcctgccctccatctcagccattggggcagggaccctcctacactacagaggggccaggggatccctctctccctagtgccttccaccctttactccccagagcagcttggcccagggaggggggatgctgcttagctgatcccgccctgacccagaggaagcctctatttatttattagcttttgtttacaccgtggaattgaccccttcctccaggggtcttgggtgggggagcccagggcccctgtgacccctcctttcttcctccaatccccagtttgtatttagctgccaaataagattcccattggctccctgtgttctcttggggggtcagggtgctgtcccctcccctctgtttacatctcccctctaccccgctgtatcgcatattgctgagttttctatttttgcaaaataaagtgatggaaactc

SEQ ID NO: 595 - DNA, 1761 bp, Homo sapiens
tcgtgacgaagccatcatggcggcggccagaggcctgcccggctcccggaagcaggctgtgaggggcgggagcgctgctggaacccgagccggagccggagccacagcggggagggtggcctggcggcctggagccggacgtgtccggggcgtccccgcagaccggggcagcaggtcgtccgggggcccaccatgctggtgactgcctaccttgcttttgtaggcctcctggcctcctgcctggggctggaactgtcaagatgccgggctaaaccccctggaagggcctgcagcaatccctccttccttcggtttcaactggacttctatcaggtctacttcctggccctggcagctgattggcttcaggccccctacctctataaactctaccagcattactacttcctggaaggtcaaattgccatcctctatgtctgtggccttgcctctacagtcctctttggcctagtggcctcctcccttgtggattggctgggtcgcaagaattcttgtgtcctcttctccctgacttactcactatgctgcttaaccaaactctctcaagactactttgtgctgctagtggggcgagcacttggtgggctgtccacagccctgctcttctcagccttcgaggcctggtatatccatgagcacgcggaacggcatgacttccctgctgagtggatcccagctacctttgctcgagctgccttctggaaccatgtgctggctgtagtggcaggtgtggcagctgaggctgtagccagctggatagggctggggcctgtagcgccctttgtggctgccatccctctcctggctctggcaggggccttggcccttcgaaactggggggagaactatgaccggcagcgtgccttctcaaggacctgtgctggaggcctgcgctgcctcctgtcggaccgccgcgtgctgctgctgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagaggtaccaccttcagcccatgcacctgctgtcccttgctgtgctcatcgtcgtcttctctctcttcatgttgactttctctaccagcccaggccaggagagtccggtggagtccttcatagcctttctacttattgagttggcttgtggattatactttcccagcatgagcttcctacggagaaaggtgatccctgagacagagcaggctggtgtactcaactggttccgggtacctctgcactcactggcttgcctagggctccttgtcctccatgacagtgatcgaaaaacaggcactcggaatatgttcagcatttgctctgctgtcatggtgatggctctgctggcagtggtgggactcttcaccgtggtaaggcatgatgctgagctgcgggtaccttcacctactgaggagccctatgcccctgagctgtaaccccactccaggacaagatagctgggacagactcttgaattccagctatccgggattgtgcagatctctctgtgactgactttgtgactgtcctgtggtttctcctgccattgctttgtgtttgggaggacatgatgggggtgatggactggaaagaaggtgccaaaagttccctctgtgttactcccatttagaaaataaacacttttaaatgat

SEQ ID NO: 596 - DNA, 661 bp, Homo sapiens
agagacttcctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaaaaaaaaaaaaaaaaaaaaaaaaaaaaaaaaaaaaaaaaaaaaaaaaaaaaaaaaaa

SEQ ID NO: 597 - DNA, 629 bp, Homo sapiens
agagacttcctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaaaaaaaaaaaaaaaaaaaaaaaaaaaaaaaaaaaaaaaaaaaaaaaaaaaaaaaaaa

SEQ ID NO: 598 - DNA, 526 bp, Homo sapiens
agagacttcctcttcgttaagtcggccttcccaacatggcgcagtctattaacatcacggagctgaatctgccgcagctagaaatgctcaagaaccagctggaccagatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaaaaaaaaaaaaaaaaaaaaaaaaaaaaaaaaaaaaaaaaaaaaaaaaaaaaaaaaaa

SEQ ID NO: 599 - DNA, 1200 bp, Homo sapiens
ctccctgcagggagctgcttatgggacaccgcttcctgcgcggcctcttaacgctgctgctgccgccgccacccctgtatacccggcaccgcatgctcggtccagagtccgtcccgcccccaaaacgatcccgcagcaaactcatggcaccgccccgaatcgggacgcacaatggcaccttccactgcgacgaggcactggcatgcgcactgcttcgcctcctgccggagtaccgggatgcagagattgtgcggacccgggatcccgaaaaactcgcttcctgtgacatcgtggtggacgtggggggcgagtacgaccctcggagacaccgatatgaccatcaccagaggtctttcacagagaccatgagctccctgtcccctgggaagccgtggcagaccaagctgagcagtgcgggactcatctatctgcacttcgggcacaagctgctggcccagttgctgggacctagtgaagaggacagcatggtgggcaccctctatgacaagatgtatgagaactttgtggaggaggtggatgctgtggacaatgggatctcccagtgggcagagggggagcctcgatatgcactgaccactaccctgagtgcacgagttgctcgacttaatcctacctggaaccaccccgaccaagacactgaggcagggttcaagcgtgcaatggatctggttcaagaggagtttctgcagagattagatttctaccaacacagctggctgccagcccgggccttggtggaagaggcccttgcccagcgattccaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgtgtgcccaaggagccccactcattccaaagccggctgcccctgccagagccatggcggggtcttcgggacgaggccctggaccaggtcagtgggatccctggctgcatcttcgtccatgcaagcggcttcattggcggtcacccgacccgagagggtgccttgagcatggcccgtgccaccttggcccagcgctcatacctcccacaaatctcctagtctaataaaaccttccatctcaaaaaaaaaaaaaaaaaaaaaaaaaaaa

SEQ ID NO: 600 - DNA, 2083 bp, Homo sapiens
ctaagacggataacgcgtcatctcgccttcccaaattttcccccctcgctagaccgggtccaaaacctccatccggagccggcaggagaggagaacgatgtttaactcggtcaacctgggcaacttctgctctccgtcgcgcaaggagaggggcgcagatttcggcgagcgagggagctgcgcctccaacctctatctgcccagttgcacttactacatgcccgagttctccacggtctcctccttcctgccccaggccccctctcgtcagatctcctatccctactcggcccaagtgcccccggtccgggaggtctcctacggcctggagccatccggcaagtggcaccatcggaacagctactcctcctgctatgcggcggccgacgagcttatgcaccgggagtgcctgcctccttccaccgtcaccgagatcctcatgaaaaacgaaggctcctacggcggccaccaccaccccagcgccccgcacgcaacccccgccggcttctactcctcagtcaacaagaacagcgtcctgcctcaagccttcgaccgtttcttcgacaacgcctactgcggtggcggcgacccgcccgccgagcccccctgctccggcaagggcgaggccaagggggagcccgaggcacccccggcctcgggactggcgtcccgggctgaggcgggtgccgaggcggaggctgaggaggagaacacaaatcccagctcgtccggttcagcccactccgtggccaaggagccggccaaaggagccgcccccaacgccccccgcacccgcaagaagcgctgcccttattcgaaattccagatccgggaactggagcgagagtttttcttcaacgtgtatatcaacaaagagaagcggctgcagctgtcccggatgctgaacctgacggaccgacaagtgaaaatttggtttcagaacagaaggatgaaagaaaagaaactgagcagagaccggctgcagtatttctcgggaaatcctctgctgtaacctgcagaccgggcccttttgggggcggggggaggggaaaattattttattttatttttattttttattttctaactcgtcttctttccgccggtggaaaactggactgtggccagggctggcccccaccgctgtggccggcactccattccggaacctcctggaccctctatctgactctcgctgtgggacagggaccgggcctggaaagggggtgaagggaagtgtctgatgcacggcgagtgaacaccgttggcgccgaggccaagactttgatttaaaagaaaacacacctcggcgacaatgtcttgctgctcggattaggtgggggaggggcgacagtagtgagcgcctgagccgaacaatcctcgaactaaaagccttcccttgcccatgtgaaaagatccgctaagacagcatgtctgccagcggaaacttctcgagctcccccctctaccccgccccaccttgccccactactttagggggcagctaaatgtgatcctgccttgctgtgaaatttctgtaccttcaacctggtgttaggtgtgcaaagtccgtgtcctacctccgtcttcgccaaggccccgcccgagcctagttgttctccccctgaatgtgtagaaccttcctttgaaatttcttaatcggtgcattgaggtttccacatctttttccaagcagtgccccacttcatggatttatagctatagtctatgcagtcgttacctcttttttttttttttttttaagaaaattgaagattggggtggtggaggcagtagggagatgggattgggcacctcccccgtgctggggcctggatttttgtaaataaatttcccaagcgtttctttccacctggagggaaagggggggacgcccccagtgagattcaaatcacgcatctctactcctctgcgtgagtgcgtgtgtacatgtgcactccccaccctgctcccttcccagagggattgctgtgaaatttttttggtggcaaataaagataaatttcattctgttcaaaaaaaaaaaaaaaaaaaaaaaaaaaaaaaaaaaaaaaaaaaaaaa

SEQ ID NO: 601 - DNA, 1672 bp, Homo sapiens
ttttgtctgtcctggattggagccgtccctataaccatctagttccgagtacaaactggagacagaaataaatattaaagaaatcatagaccgaccaggtaaaggcaaagggatgaattcctacttcactaacccttccttatcctgccacctcgccgggggccaggacgtcctccccaacgtcgccctcaattccaccgcctatgatccagtgaggcatttctcgacctatggagcggccgttgcccagaaccggatctactcgactcccttttattcgccacaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtggggtcggctacggagcggaccggaggcgcggccgccagatctactcgcggtaccagaccctggaactggagaaggaatttcacttcaatcgctacctaacgcggcgccggcgcatcgagatcgccaacgcgctttgcctgaccgagcgacagatcaaaatctggttccagaaccgccggatgaagtggaaaaaagaatctaatctcacatccactctctcggggggcggcggaggggccaccgccgacagcctgggcggaaaagaggaaaagcgggaagagacagaagaggagaagcagaaagagtgaccaggactgtccctgccacccctctctccctttctccctcgctccccaccaactctcccctaatcacacactctgtatttatcactggcacaattgatgtgttttgattccctaaaacaaaattagggagtcaaacgtggacctgaaagtcagctctggaccccctccctcaccgcacaactctctttcaccacgcgcctcctcctcctcgctcccttgctagctcgttctcggcttgtctacaggcccttttccccgtccaggccttgggggctcggaccctgaactcagactctacagattgccctccaagtgaggacttggctcccccactccttcgacgcccccacccccgccccccgtgcagagagccggctcctgggcctgctggggcctctgctccagggcctcagggcccggcctggcagccggggagggccggaggcccaaggagggcgcgccttggccccacaccaacccccagggcctccccgcagtccctgcctagcccctctgccccagcaaatgcccagcccaggcaaattgtatttaaagaatcctgggggtcattatggcattttacaaactgtgaccgtttctgtgtgaagatttttagctgtatttgtggtctctgtatttatatttatgtttagcaccgtcagtgttcctatccaatttcaaaaaaggaaaaaaaagagggaaaattacaaaaagagagaaaaaaagtgaatgacgtttgtttagccagtaggagaaaataaataaataaataaatcccttcgtgttaccctcctgtataaatccaacctctgggtccgttctcgaatatttaataaaactgatattattttt

SEQ ID NO: 602 - DNA, 1869 bp, Homo sapiens
ggggagggtggggatgggaggggagagacagaagttgagggcatctctctcttccttcccgaccctctggcccccaaggggcaggaggaatgcaggagcaggagttgagcttgggagctgcagatgcctccgcccctcctctctcccaggctcttcctcctgcccccttcttgcaactctccttaattttgtttggcttttggatgattataattatttttatttttgaatttatataaagtatatgtgtgtgtgtgtggagctgagacaggctcggcagcggcacagaatgagggaagacgagaaagagagtgggagagagagaggcagagagggagagagggagagtgacagcagcgctcggacgtcctccccaacgtcgccctcaattccaccgcctatgatccagtgaggcatttctcgacctatggagcggccgttgcccagaaccggatctactcgactcccttttattcgccacaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtggggtcggctacggagcggaccggaggcgcggccgccagatctactcgcggtaccagaccctggaactggagaaggaatttcacttcaatcgctacctaacgcggcgccggcgcatcgagatcgccaacgcgctttgcctgaccgagcgacagatcaaaatctggttccagaaccgccggatgaagtggaaaaaagaatctaatctcacatccactctctcggggggcggcggaggggccaccgccgacagcctgggcggaaaagaggaaaagcgggaagagacagaagaggagaagcagaaagagtgaccaggactgtccctgccacccctctctccctttctccctcgctccccaccaactctcccctaatcacacactctgtatttatcactggcacaattgatgtgttttgattccctaaaacaaaattagggagtcaaacgtggacctgaaagtcagctctggaccccctccctcaccgcacaactctctttcaccacgcgcctcctcctcctcgctcccttgctagctcgttctcggcttgtctacaggcccttttccccgtccaggccttgggggctcggaccctgaactcagactctacagattgccctccaagtgaggacttggctcccccactccttcgacgcccccacccccgccccccgtgcagagagccggctcctgggcctgctggggcctctgctccagggcctcagggcccggcctggcagccggggagggccggaggcccaaggagggcgcgccttggccccacaccaacccccagggcctccccgcagtccctgcctagcccctctgccccagcaaatgcccagcccaggcaaattgtatttaaagaatcctgggggtcattatggcattttacaaactgtgaccgtttctgtgtgaagatttttagctgtatttgtggtctctgtatttatatttatgtttagcaccgtcagtgttcctatccaatttcaaaaaaggaaaaaaaagagggaaaattacaaaaagagagaaaaaaagtgaatgacgtttgtttagccagtaggagaaaataaataaataaataaatcccttcgtgttaccctcctgtataaatccaacctctgggtccgttctcgaatatttaataaaactgatattattttt

SEQ ID NO: 603 - DNA, 1570 bp, Homo sapiens
aacgggatggggagctggaccagcagattatgagcttacagaaagcctggcctacattttactctttttggatttcttcctcatcaagagactgctgcagtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttgaactgtcttccaacctgccatggcagttttgacactactcctgtttgccctcctgattcctgctttctttaccttttaacattgcccctttcaggggaccccactttgtagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttacctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggc

SEQ ID NO: 604 - DNA, 1769 bp, Homo sapiens
gagagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctctaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggcaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaa

SEQ ID NO: 605 - DNA, 1925 bp, Homo sapiens
gagagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctctaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggcaatgatggtggttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaa

SEQ ID NO: 606 - DNA, 1900 bp, Homo sapiens
ttttgcggctccacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaactgaaa

SEQ ID NO: 607 - DNA, 567 bp, Homo sapiens
cagcgggcacgtgacatggccccggggagccgaggtgagcgtccagcttccggagccggagggggcccggcgtacccagcccccagcccgacgtgaccatgctgtcccgcctcctaaaagaacaccaggccaagcagaatgaacgcaaggagctgcaggaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactgcactggaatatgtctacaaagggcagctgcagtctgccccttcctagcccctgttccctccccaaaccctatccctcctacctcacccgcagggggaaggagggaggctgacaagccttgaataaaacacaagcctcc

SEQ ID NO: 608 - DNA, 916 bp, Homo sapiens
ggccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaagaaaaaaaaaaaaaaaaaaaaaa

SEQ ID NO: 609 - DNA, 1271 bp, Homo sapiens
ggatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggcccggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttattctccatactgtcttctacacctttaaagcctgagaactatacaacctttcccagactcccaagaagagaagagattggcaaatggggctcctgggcccagtcctgctagtggcaagtttctttgaatcaggaaggcaggtgaggtaagggccaaatcactctcctccatagcaggaagccatttgggcagcttctttggtgattacatctttccatatcttttacacttaccaccttccagctctgttttgctgtgtatttttcttacaataatttttttcagctatagctgcagtttaatcaggatgggtagagagctgtcctcataaggctgggggtgggaagatggaatactgacctaatgtataaaacttaaaacaattctccaatcccctctcctttggtccagtaggaggtgcccttcactctaagcttaacacttagtagggaagagattctcaaatgagaaaaagggctccggctatatgggcaacaaagagggaagatacaggttgccagttatacatttatagaaagataatcccctggctttaaatagtcatgtacatacaaatatgaacaaacttaaaaaaaaaatacaaacccttggatcacatgggggcttctgggaacccccgtattcttccccctcacccaagggcagtgggcatgaatctactttttaaaaatgattaattttgacaaaaaaaaaaaaaaaaaaaaaaaaaaa

SEQ ID NO: 610 - DNA, 704 bp, Homo sapiens
attactgcaggaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagcgtttgtgaggcatatcctgtcggggtgacgggcccatggggcggagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctgggcctc

SEQ ID NO: 611 - DNA, 651 bp, Homo sapiens
ggaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctgggaaaaa

SEQ ID NO: 612 - DNA, 674 bp, Homo sapiens
gcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagcgtttgtgaggcatatcctgtcggggtgacgggcccatggggcggagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctgggaaaaa

SEQ ID NO: 613 - DNA, 717 bp, Homo sapiens
attactgcaggaaaaggtcccggagagctgagcagtcaagatgtgtgacttcaccgaagaccagaccgcagatctgatcccaagcactgagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagcgtttgtgaggcatatcctgtcggggtgacgggcccatggggcgagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctggg

SEQ ID NO: 614 - DNA, 3881 bp, Homo sapiens
ttcgcgctgactcagcggcggcggcggctgcggcggcggcggcggcgttagccggccctcgcgctctttcccttcctggggcgccgaccccgcccgcttgcttgcttgcttgcttgcctgcctgcctgcctgcccggcgccacgcaagagaaggtgccaggggacgcagagcgactagaggcgcgcggtcccggccagcaccgtctctggcgttgtagctgcggccgtggcggaggactacggcgacaaggacgagggccgctctcccagctctctgcgtgccgcgccgctccgctccgctggctgaccatctggagtgcaggctgggaggcgggatggagtgatagggaagatgtttataaattcttctgtgggatcagagggcacgcctattacaaccagaaaactacaagtataacagcgaggatggatgaacaggctctattagggctaaatccaaatgctgattcagactttagacaaagggccctggcctattttgagcagttaaaaatttccccagatgcctggcaggtgtgtgcagaagctctagcccagaggacatacagtgatgatcatgtgaagtttttctgctttcaagtactggaacatcaagttaaatacaaatactcagaactaaccactgttcaacaacagctaattagggagacgctcatatcatggctgcaagctcagatgctgaatccccaaccagagaagacctttatacgaaataaagccgcccaagtcttcgccttgctttttgttacagagtatctcactaagtggcccaagtttttttttgacattctctcagtagtggacctaaatccaaggggagtagatctctacctgcgaatcctcatggctattgattcagagttggtggatcgtgatgtggtgcatacatcagaggaggctcgtaggaatactctcataaaagataccatgagggaacagtgcattccaaatctggtggaatcatggtaccaaatattacaaaattatcagtttactaattctgaagtgacgtgtcagtgccttgaagtagttggggcttatgtctcttggatagacttatcccttatagccaatgataggtttataaatatgctgctaggtcatatgtcaatagaagttctacgggaagaagcatgtgactgtttatttgaagttgtaaataaaggaatggaccctgttgataaaatgaaactagtggaatctttgtgtcaagtattacagtctgctgggtttttcagcattgaccaggaagaagatgttgacttcctggccagattttctaagttggtaaatggaatgggacagtcattgatagttagttggagtaaattaattaagaatggggatattaagaatgctcaagaggcactacaagctattgaaacaaaagtggcactgatgttgcagctactaattcatgaggatgatgatatttcttctaatattattggattttgttacgattatcttcatattttgaaacagcttacagtgctctcggatcagcaaaaagctaatgtagaggcaatcatgttggccgttatgaaaaaattgacttacgatgaagaatataactttgaaaatgagggtgaagatgaagccatgtttgtagaatatagaaaacaactgaagttactgttggacaggcttgctcaagtttcaccagagttactactggcctctgttcgcagagtttttagttctacactgcagaattggcagactacacggtttatggaagttgaagtagcaataagattgctgtatatgttggcagaagctcttccagtatctcatggtgctcacttctcaggtgatgtttcaaaagctagtgctttgcaggatatgatgcgaactctggtaacatcaggagtcagttcctatcagcatacatctgtgacattggagttcttcgaaactgttgttagatatgaaaagtttttcacagttgaacctcagcacattccatgtgtactaatggctttcttagatcacagaggtctgcggcattccagtgcaaaagttcggagcaggacggcttacctgttttctagatttgtcaaatctctcaataagcaaatgaatcctttcattgaggatattttgaatagaatacaagatttattagagctttctccacctgagaatggccaccagtccttactgagcagcgatgatcaactttttatttatgagacagctggagtgctgattgttaatagtgaatatccggcagaaaggaaacaagccttaatgaggaatctgttgactccactaatggagaagtttaaaattctgttagaaaagttgatgctggcacaagatgaagaaaggcaagcctctctagcagactgtcttaaccatgctgttggatttgcaagtcgaaccagtaaagctttcagcaacaaacagactgtgaaacaatgtggctgttccgaagtttatctggactgtttacagacattcttgccagccctcagttgtcccttacaaaaggatattctcagaagtggagtccgtactttccttcatcgaatgattatttgcctggaggaagaagttcttccgttcattccatctgcttcagaacatatgctcaaagattgtgaagcaaaagatctccaggagttcattcctcttatcaaccagattacggccaaattcaagatacaggtatccccgtttttacaacagatgttcatgcccctgcttcatgcaatttttgaagtgctgctccggccagcagaagaaaatgaccagtctgctgctttagagaagcagatgttgcggaggagttactttgctttcctgcaaacagtcacaggcagtgggatgagcgaagttatagcaaatcaaggtgcagagaatgtagaaagagtgttggttactgttatccaaggagcagttgaatatccagatccaattgcacagaaaacatgttttatcatcctctcaaagttggtagaactctggggaggtaaagatggaccagtgggatttgctgattttgtttataagcacattgtccccgcatgtttcctagcacctttaaaacaaacctttgacctggcagatgcacaaacagtattggctttatctgagtgtgcagtgacactgaaaacaattcatctcaaacggggcccagaatgtgttcagtatcttcaacaagaatacctgccctccttgcaagtagctccagaaataattcaggagttttgtcaagcgcttcagcagcctgatgctaaagtttttaaaaattacttaaaggtgttcttccagagagcaaagccctgaggactggatttccctgtgcctacttcatgatcatgaattccagttaatttataaagaggcgatttttgtgtgccattcacactggtctttttcacattgttttgagcttattgcagtatatgttttgggatttttctgtaaaatgggtgtaattttcctaatacaggtatgtaacaacaaaagaagttgcctgcatgccggtccaaattgttctgtataaagatgctcttaaaagacacaagagttatcctagaaccttaattcttttttatttgaaattttaagtcaagtcctttataaagaccatagcagtggaaaacagtgtactttttaaaaaattgctgaatataaaatctttgaaaattttctttatgtgtgaagacacaaagtatgggggaagacagcaatcaaaactaactttttgtagatagccatttcatttctttaaactgtttcaacgccaatatgtattctacaaaagagaatggttttaggctccagtgttatacttttttttatatatatatataaaaataaactttacgtagtgaaaaaaaaaaaaaaaa

SEQ ID NO: 615 - DNA, 2982 bp, Homo sapiens
gccggcggtggcgcggcggagacccggctggtataacaagaggattgcctgatccagccaagatgcagagcacttctaatcatctgtggcttttatctgatattttaggccaaggagctactgcaaatgtctttcgtggaagacataagaaaactggtgatttatttgctatcaaagtatttaataacataagcttccttcgtccagtggatgttcaaatgagagaatttgaagtgttgaaaaaactcaatcacaaaaatattgtcaaattatttgctattgaagaggagacaacaacaagacataaagtacttattatggaattttgtccatgtgggagtttatacactgttttagaagaaccttctaatgcctatggactaccagaatctgaattcttaattgttttgcgagatgtggtgggtggaatgaatcatctacgagagaatggtatagtgcaccgtgatatcaagccaggaaatatcatgcgtgttataggggaagatggacagtctgtgtacaaactcacagattttggtgcagctagagaattagaagatgatgagcagtttgtttctctgtatggcacagaagaatatttgcaccctgatatgtatgagagagcagtgctaagaaaagatcatcagaagaaatatggagcaacagttgatctttggagcattggggtaacattttaccatgcagctactggatcactgccatttagaccctttgaagggcctcgtaggaataaagaagtgatgtataaaataattacaggaaagccttctggtgcaatatctggagtacagaaagcagaaaatggaccaattgactggagtggagacatgcctgtttcttgcagtctttctcggggtcttcaggttctacttacccctgttcttgcaaacatccttgaagcagatcaggaaaagtgttggggttttgaccagttttttgcagaaactagtgatatacttcaccgaatggtaattcatgttttttcgctacaacaaatgacagctcataagatttatattcatagctataatactgctactatatttcatgaactggtatataaacaaaccaaaattatttcttcaaatcaagaacttatctacgaagggcgacgcttagtcttagaacctggaaggctggcacaacatttccctaaaactactgaggaaaaccctatatttgtagtaagccgggaacctctgaataccataggattaatatatgaaaaaatttccctccctaaagtacatccacgttatgatttagacggggatgctagcatggctaaggcaataacaggggttgtgtgttatgcctgcagaattgccagtaccttactgctttatcaggaattaatgcgaaaggggatacgatggctgattgaattaattaaagatgattacaatgaaactgttcacaaaaagacagaagttgtgatcacattggatttctgtatcagaaacattgaaaaaactgtgaaagtatatgaaaagttgatgaagatcaacctggaagcggcagagttaggtgaaatttcagacatacacaccaaattgttgagactttccagttctcagggaacaatagaaaccagtcttcaggatatcgacagcagattatctccaggtggatcactggcagacgcatgggcacatcaagaaggcactcatccgaaagacagaaatgtagaaaaactacaagtcctgttaaattgcatgacagagatttactatcagttcaaaaaagacaaagcagaacgtagattagcttataatgaagaacaaatccacaaatttgataagcaaaaactgtattaccatgccacaaaagctatgacgcactttacagatgaatgtgttaaaaagtatgaggcatttttgaataagtcagaagaatggataagaaagatgcttcatcttaggaaacagttattatcgctgactaatcagtgttttgatattgaagaagaagtatcaaaatatcaagaatatactaatgagttacaagaaactctgcctcagaaaatgtttacagcttccagtggaatcaaacataccatgaccccaatttatccaagttctaacacattagtagaaatgactcttggtatgaagaaattaaaggaagagatggaaggggtggttaaagaacttgctgaaaataaccacattttagaaaggtttggctctttaaccatggatggtggccttcgcaacgttgactgtctttagctttctaatagaagtttaagaaaagtttccgtttgcacaagaaaataacgcttgggcattaaatgaatgcctttatagatagtcacttgtttctacaattcagtatttgatgtggtcgtgtaaatatgtacaatattgtaaatacataaaaaatatacaaatttttggctgctgtgaagatgtaattttatcttttaacatttataattatatgaggaaatttgacctcagtgatcacgagaagaaagccatgaccgaccaatatgttgacatactgatcctctactctgagtggggctaaataagttattttctctgaccgcctactggaaatatttttaagtggaaccaaaataggcatccttacaaatcaggaagactgacttgacacgtttgtaaatggtagaacggtggctactgtgagtggggagcagaaccgcaccactgttatactgggataacaatttttttgagaaggataaagtggcattattttattttacaaggtgcccagatcccagttatccttgtatccatgtaatttcagatgaattattaagcaaacattttaaagtgaattcattattaaaaactattcatttttttcctttggccataaatgtgtaattgtcattaaaattctaaggtcatttcaactgttttaagctgtatatttctttaattctgcttactatttcatggaaaaaaataaatttctcaattttaatgt

SEQ ID NO: 616 - DNA, 5130 bp, Homo sapiens
cacgtgatcgcgcctagggagaaaacgtctgactccagccaccggccttcaaggcacggctttttattccttcggctggtcggcctctcgcccttcagctacctgtgcgtccctccgtcccgtcccgtcccggggtcaccccggagcctgtccgctatgcggctcctgcctctagccccaggtcggctccggcggggcagcccccgccacctgccctcctgcagcccagcgctgctactgctggtgctgggcggctgcctgggggtcttcggggtggctgcgggaacccggaggcccaacgtggtgctgctcctcacggacgaccaggacgaagtgctcggcggcatgacaccgctaaagaaaaccaaagctctcatcggagagatggggatgactttttccagtgcttatgtgccaagtgctctctgctgccccagcagagccagtatcctgacaggaaagtacccacataatcatcacgttgtgaacaacactctggaggggaactgcagtagtaagtcctggcagaagatccaagaaccaaatactttcccagcaattctcagatcaatgtgtggttatcagaccttttttgcagggaaatatttaaatgagtacggagccccagatgcaggtggactagaacacgttcctctgggttggagttactggtatgccttggaaaagaattctaagtattataattacaccctgtctatcaatgggaaggcacggaagcatggtgaaaactatagtgtggactacctgacagatgttttggctaatgtctccttggactttctggactacaagtccaactttgagcccttcttcatgatgatcgccactccagcgcctcattcgccttggacagctgcacctcagtaccagaaggctttccagaatgtctttgcaccaagaaacaagaacttcaacatccatggaacgaacaagcactggttaattaggcaagccaagactccaatgactaattcttcaatacagtttttagataatgcatttaggaaaaggtggcaaactctcctctcagttgatgaccttgtggagaaactggtcaagaggctggagttcactggggagctcaacaacacttacatcttctatacctcagacaatggctatcacacaggacagttttccttgccaatagacaagagacagctgtatgagtttgatatcaaagttccactgttggttcgaggacctgggatcaaaccaaatcagacaagcaagatgctggttgccaacattgacttgggtcctactattttggacattgctggctacgacctaaataagacacagatggatgggatgtccttattgcccattttgagaggtgccagtaacttgacctggcgatcagatgtcctggtggaataccaaggagaaggccgtaacgtcactgacccaacatgcccttccctgagtcctggcgtatctcaatgcttcccagactgtgtatgtgaagatgcttataacaatacctatgcctgtgtgaggacaatgtcagcattgtggaatttgcagtattgcgagtttgatgaccaggaggtgtttgtagaagtctataatctgactgcagacccagaccagatcactaacattgctaaaaccatagacccagagcttttaggaaagatgaactatcggttaatgatgttacagtcctgttctgggccaacctgtcgcactccaggggtttttgaccccggatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgtattctttttatcctggggccacagttcttgattattcctcttgtggttaaagactgaatttgtaaacccattcagataaatggcagtactttaggacacacacaaacacacagacacaccttttgatatgtaagcttgacctaaagtcaaaggacctgtgtagcatttcagattgagcacttcactatcaaaaatactaacatcacatggcttgaagagtaaccatcagagctgaatcatccaagtaagaacaagtaccattgttgattgataagtagagatacattttttatgatgttcatcacagtgtggtaaggttgcaaattcaaaacatgtcacccaagctctgttcatgtttttgtgaattctaggctggtgctgcactgaaatagagcagtaagcttgtgataaaggccaattccaggtagctcttgaaggtgatagccatctactttccagtggctgccaaccacagggagtgccagttaacactggaaggattaaggcaaggtcccttctcttgagactcccctctgagatctgaaaaatgaagtggcttaggaacatcagcagtgaagaactgccaagagttggtgaaggttgtctcttccgagggccttctgaagacagggctcttgaacagacaagtggaagggctgtaccagggataaaggaaagaagtgcctgtccagcagggagcttgaatttaagttccatgtatgaagtcattggctctatctgcatttttctgtcattctcttcatttgttttaaggtggaaaattttcttacagttgatgcaaagtatcaactactttaccctaccttctccccttttagatgggttcttcctgagttttggagtcttgtatgattatcagtattcccctgtcaaaatcaaatctattcaggtttcttcactgttgagaacacctaaatgtttttatttttgagaagtggggacagagtctcactatgtcacccaggctggagtgcaatggcatgatctcagctcactgcaaccttcgcctcctgggttcaagcgattctcctgcctccgcctcctgagtagctgggattataggcacgcaccaccacgcccagctaattttttgtatttttagtagagacagagtttcaccatgttggccaggctggtcttgaactcctgaccttgtgatccacccacctcggcctcccagagtgctgggattacaggcatgagccaccacgcttggctaagaacacctaaatttttatgtttcttggctcaaaaaccagttccatttctaatgttgtcctcacaagaaggctaattggtggtgagacagcaggggaggaggaagagctgtggtttgtaacttgttcaactcaggcaataagcgattttagctttatttaaagtcttctgtccagctttaagcactttgtaagacatggctgaaagtagcttttctatcagaattgcagatagtcatgttgggctaacagtcaattggatatattcctttacctcacatgaccccagcaactgtggtggtatctagaggtgaaacaggcaagtgaaatggacacctctgctgtgaatgttttagagaaggaaattcaaaaaatgttgtaactgaaagcactgttgaatatgggtatcggctttctttttcactttgactcttaacattatcagtcaacttccacattaatgaaagttgaccatagttatttccaaataaaaagaaaccaactcttaccaggtcttggactgtgatgtcatattattcagttttatgcttgttcctgagcagaactcataagagtgacatagtcagctgctgacggcacctcagccacgccactcttactcagttcagtgggtgtgcttgcgtggtaggatgtggtgcagccctctctacgctcttctatttttggtatatttcctatctaaccttcaaatagcttccaattctttttttcttggactggcttcattctgaatttgtgctaaaataatctttcataaagagacctcagtttatagcgtaacagactacacaatgcactgatgttttcataatgtttaagggacccactgcaagaagcttgctgcctccttttaattgtattcatttagattttgattttccatgttaagaaggtgaggtccatgttggtgcccttcagagtagagaaccatgtaaacattaggaatgaacagaggccttaggaatgaatagagagtttgccttatacaatttcctgttacaaagctctccctctcatgcaaagtagggaacaccttttgagcatctttgaatttgacaaatggtgctgttgcaaacactttttttttgagatgaagtctcgcggttgtcacccgggctggagtgcagtggcgtgatctcggctcactgcaacttccacctcctgggttccagcagttctcctgcctcagcctcccaagtagctgagattacaggcgcctgccaccccacctggctgatttttgtaattttagtagagacggggtttcaccatgttggccaggctgattaactcctgacctcaggtgatccacctttctcggcctcccaaagtgctgggattacgggtgtgagccaccgtgcccggcctgcaaacacattttaattgacaacactagggctgttgtacaaaatagtaatgatagccatggaagttttaccttattctgtgagaagtgttcttaaacttattaagtgtctaaactaaggtttagtgcttttttaaaggaaagttgtcccaggattcatcctaaagaaagcaaaagttaattcaactgatccaccaatggaattagatgggtagagttgggttcttgagttttaccaccacttagttcccactgaattttgtaacttcctgtgtttgcatcctctgttcctattctgcccttgctctgtgtcatctcagtcatttgacttagaaagtgcccttcaaaaggaccctgttcactgctgcacttttcaatgaattaaaatttatttctgttctagtgggaaaaaaaaaaaaaaaaaa

SEQ ID NO: 617 - DNA, 5130 bp, Homo sapiens; identical to SEQ ID NO: 616

SEQ ID NO: 618 - DNA, 4785 bp, Homo sapiens
gagaaaatggcggcggcagcagcttcggcgcctcagcagctctcggatgaggagcttttctctcagctccgccgttacggcctgtctcccggaccagtgacggagagcacccgcccggtctacctcaagaagctgaagaagcttcgagaggaagagcagcaacagcaccggtcagggggccgcggcaacaagacgcggaacagtaataacaataacacggcagccgccacggtcgcagccgcgggaccagcggcggcggcggccgcggggatgggggtccggccggtctcgggcgacctctcctacttacggactcctgggggcctgtgccgaatctcggcctctggcccagagagcctcctgggagggcccgggggcgcctccgccgcccccgcggctggcagcaaagtgctgctgggcttcagctcggacgagtcggacgtggaggccagtccccgggaccaggccggcggcggcgggaggaaagaccgggcttcgctccagtaccgcgggctcaaagcgccgccggcgcccctggccgccagcgaggtgactaacagcaactctgcagagcgaaggaagccccactcgtggtggggggccaggaggccggcgggccccgagctgcagaccccgccggggaaagatggagcagtggaggacgaggaaggggagggagaggacggtgaggagagggacccggagaccgaggagccgctctgggcgagccggaccgtgaatggcagccggcttgtcccctacagctgccgggaaaactattcggactcagaggaagaggacgacgacgacgtggcctccagcagacaggtattaaaggacgactccctttcccggcatcggcccagacgaacccatagtaagcctctccccccgctgactgctaaatcggccggcggcaggctggagacttcagttcagggagggggaggactcgcgatgaatgacagggcggcggctgccgggagtctagacaggagccgaaacctcgaagaggcggcggccgcggagcagggaggagggtgtgatcaagtggactccagccccgttcctagataccgtgttaacgctaagaaactgacccctctcctgcccccgccacttactgacatggactcaaccttggattcgtcaacaggctcccttctgaaaaccaataatcatattggcggtggggccttcagtgtggactcccccaggatttattctaacagtctccctcccagtgcggcggtggccgcctctagttcactcaggatcaatcacgccaatcatacgggctccaatcatacctacctgaaaaacacatacaacaaaccgaagctttccgaacccgaagaggaacttctccagcaatttaaacgggaggaggtgtccccaacagggagtttcagtgcccactacttgtcgatgtttctcttaactgctgcctgcttatttttcctaatactgggactgacttacctaggaatgagagggacaggagtatctgaggatggagaactcagcatagaaaacccctttggtgaaacatttggaaaaatacaagaaagtgaaaaaactcttatgatgaacacattatataagcttcatgatcgattggcacagcttgcaggagatcatgaatgtggcagttctagtcaaagaacgctttctgttcaagaggcagctgcgtatttaaaagatttaggtcctgaatatgaaggtatatttaacacttcattgcagtggatcttagaaaatggaaaagatgttggaataaggtgtgttggttttggccctgaggaagaattgacaaatataactgatgtgcagtttttacagtccacaagaccactgatgtctttttggtgtcgttttcgacgtgcttttgttactgtaactcacagattattgttgttatgcttaggtgtagtgatggtttgtgtcgttctgcgttacatgaaatatcgatggacaaaagaagaggaggaaacaaggcagatgtatgatatggtggtaaagattatagatgttttacgaagtcataatgaagcctgccaggaaaacaaagatttacaaccttacatgcctattccacatgtacgcgattccttaatacagcctcatgacaggaaaaaaatgaagaaagtctgggatagagctgttgacttccttgctgctaatgagtctagagttcgcacggaaacacgaagaataggtggtgcagattttctggtttggcggtggatccagccttctgcatcctgtgacaaaatattagttataccttctaaagtatggcaaggtcaagcatttcatttagatagaagaaattcaccaccaaatagtttgacaccgtgtctaaagattcggaatatgtttgatcccgttatggaaataggggatcagtggcatttggcaattcaagaagcaattttagaaaaatgcagtgataatgatggcattgttcacattgcagtagacaaaaattcacgtgagggttgtgtatatgttaaatgtctgtctccagaatatgctggaaaggcttttaaagcattgcatggctcttggtttgatgggaaattggttacagtaaaatatttacgactagatagataccaccatcgctttccccaggctctcacttccaacactccattgaagccatcaaataaacatatgaactccatgtctcatcttcgtcttcggactggcctaaccaattctcaaggaagttcctgaaaagattttcttccatttctaagactgttatttacaataggaaaattcctgtttggctttttgtcttcctttttaaatgctttttgtatgtaatatttttattgatgaatacatctctgaacgttccagaagtcttaaggttccaaagggatttagcagtgaggcagcaatgctgagtaggtaggataattatttcattcagtttttggagctcagttaagccaatacatttaaagttttgcatgaggaacactgactttattaagcattttcagatgtggtggttgtatttttgccccaagaagtgtttggataaccacacaaaagcatgatgaaaaggcttcttgtagtcccataatttcttgtgaactaatgttgtgaatttttgtatacagtcacctgcatagttcctacaggctaatgtggtaaaactgttgatttcccaatttaaccttaggtttctgttgcttataagcgattcatttgctacggctggaatatgggaaaattaatttgggcttagtggttacaaatatgtgtaagtggatgtatatgtacttaaactggctttgtatatatgtataaatgctggtggtggtgaaagtagtcttgttttatgaggatgtctgcattaaagcagtaaaataagctttccattttattcataatctaatgtgtgtgtatatatgtatgtgtgtatgtgtgtgtatatatagatgtatatatatacacacacagagatatatacatatggctgtacttttgcatagatcaaacagccaaacacctggaagtattagatacaagtttaaaatatcttttataggttttatataaaaatgtctgagtatgattttgtgtgaaagttctgataccagttgtaatagagtcaaatttatgtgagcaataaagaagaaattggcagatattggaaaaatattttgtgaaaagctgtatttattataaatactagggccatgacatagtaccattggggttaagtcattttcccaatctatttataatttaatgatatgttagtgcctctgttatatgtcaagtttaaagcagggcacattgttgcagcaaaatgtgtatttgacaaattatacttgcaattttgggtcatgaaagtttgcaatatagtaaatgcacgattgactgttgctttgtgcctcagtatttaatttgtttcagtaaacttactttattactgtttatgatttcagataaaaatagttgctgagtaaattttacttgtaatctacaattggctttttaaaaataacctgttgatatataattgtcagtccaaatgaatatgtgaaacagctggaattgtacaaattttggttgtatttaaagctcagtttcctttttgttttattgtatgcgttgggtttgcagcatgaacttgcacagataatgcacgttttctggttaagtaaacatgatgcacactattctgtaacagaaagccctattgtgccttacctgtgtgcttttgtgggcaccttgtttatgaagaataaaaaatgatttgttatctgaagagaataaattttaaattctcagtttatgtctcagatgctaacgtgtgaaaatataaatatatataatatataaagtaaccagtcttcctgtattttatgtgcatcatagtgatttatctgagcttagtgacccccatcttgtaacctgttgcaagagtgaatgtaaaaaatagttgtggcattttaaaaggtcgcctttgatgcagatgcatctttttcttgcttctaaaacatatttcatgtaaacattgtacatttattattgtaatatatactattatgcagcttattttacctgaaactgttaagccgaccaagatccctccctgcaagacagatgggaatgtgtataataactaggtatttgagaagttctgaagtttgatgtaatctgttacttgtcctgttaaaaaaaggaaaaaattctaattaaaaatttattagtttttaaaaaaaaaaaaaaaaaaaaaaaaaaaaaaaaaaaaaaaaa

SEQ ID NO: 619 - DNA, 1325 bp, Homo sapiens
atgtggtcgagtgtaggctcccacgttggaccgggaccggtaggggtagctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgactttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaacgagaaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaa

SEQ ID NO: 620 - DNA, 5387 bp, Homo sapiens
gggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaacaaaaaccatgtttctttttcttgtataactttttgttttcagcaacataaattgatttttagctggcagacaagaatatccatataagatttgttaaccatttcagagagtttggcaatttttaaaagataataaggtatcatttttaagtatgaaaattaacaatatccctgttgcgcacactaattttgcatgagtaagtttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctattataaatcttcttacttaaattttgaatatttagtttttctcagttacccatttgtgtgtgtgtgattccacttagaaattcttaaaaccagatttttctttcattccgtttggatgtctacattccttatcaaaggatataaatactgtgtatgcttttgaattttatttttaggaaaattctgaagccagctatcacaggtttgttagctaataatagtattttcttttagttgagttaggtttttccccatctcctgtagagcgaatttacatattgtattgggtaagtgttcactacttttcctgattaagggatctgtgctggggaacaaagcttttgcagtaccttatattgtagttaaaattttatttaacatatccttcagtgagctcatttcacactgtagcctcttccttaaaatttgtggtgctcctgtaacagtaagaactaattctgaaataaaagacatctcctaaaaaaaaaaaaaaaaaaaaaaaaaaaaaaaaaaa

SEQ ID NO: 621 - DNA, 5387 bp, Homo sapiens; identical to SEQ ID NO: 620

SEQ ID NO: 622 - DNA, 3466 bp, Homo sapiens
ggactgtgtgtgtctggctgtagcagacgcgaggcggcgacgaggcgccggggacccgcgcgaggggcggccgggaggcggcggcggcggccgccagaagtagcagcaggaccggcggcggcgacggcagccctgaaatgcattttcctctccagcggccatgttaaccaggaaaccttcggccgccgctcccgccgcctacccgaccgattggcggcagtaagcacacaatgaatgatcacctgcatgtcggcagccacgctcacggacagatccaggttcaacagttgtttgaggataacagtaacaagcggacagtgctcacgacacaaccaaatgggcttacaacagtgggcaaaacgggcttgccagtggtgccagagcggcagctggacagcattcatagacggcaggggagctccacctctctaaagtccatggaaggcatggggaaggtgaaagccacccccatgacacctgaacaagcaatgaagcaatacatgcaaaaactcacagccttcgaacaccatgagattttcagctaccctgaaatatatttcttgggtctaaatgctaagaagcgccagggcatgacaggtgggcccaacaatggtggctatgatgatgaccagggatcatatgtgcaggtgccccacgatcacgtggcttacaggtatgaggtcctcaaggtcattgggaaggggagctttgggcaggtggtcaaggcctacgatcacaaagtccaccagcacgtggccctaaagatggtgcggaatgagaagcgcttccaccggcaagcagcggaggagatccgaatcctggaacacctgcggaagcaggacaaggataacacaatgaatgtcatccatatgctggagaatttcaccttccgcaaccacatctgcatgacgtttgagctgctgagcatgaacctctatgagctcatcaagaagaataaattccagggcttcagtctgcctttggttcgcaagtttgcccactcgattctgcagtgcttggatgctttgcacaaaaacagaataattcactgtgaccttaagcccgagaacattttgttaaagcagcagggtagaagcggtattaaagtaattgattttggctccagttgttacgagcatcagcgtgtctacacgtacatccagtcgcgtttttaccgggctccagaagtgatccttggggccaggtatggcatgcccattgatatgtggagcctgggctgcattttagcagagctcctgacgggttaccccctcttgcctggggaagatgaaggggaccagctggcctgtatgattgaactgttgggcatgccctcacagaaactgctggatgcatccaaacgagccaaaaattttgtgagctccaagggttatccccgttactgcactgtcacgactctctcagatggctctgtggtcctaaacggaggccgttcccggagggggaaactgaggggcccaccggagagcagagagtgggggaacgcgctgaaggggtgtgatgatccccttttccttgacttcttaaaacagtgtttagagtgggatcctgcagtgcgcatgaccccaggccaggctttgcggcacccctggctgaggaggcggttgccaaagcctcccaccggggagaaaacgtcagtgaaaaggataactgagagcaccggtgctatcacatctatatccaagttacctccaccttctagctcagcttccaaactgaggactaatttggcgcagatgacagatgccaatgggaatattcagcagaggacagtgttgccaaaacttgttagctgagctcacgtcccctgatgctggtaacctgaaagatacgacattgctgagccttactgggttgaaaaggagtagctcagacctgtttttatttgctcaataactctactcatttgtatcttttcagcacttaattttaatgtaagaaagttgttcattttgtttttataaaatacatgaggacaatgctttaagtttttatactttcagaaactttttgtgttctaaaagtacaatgagccttactgtatttagtgtggcagaataataacatcagtggcaggccactgattacttcatgactgccacgcatttacagattggtgtcaaagacattcactatgtttttatggttcatgttatatcctccccagggtgacagccccttaaggccctccttttccctccatgctccaggtccatgcacaggtgtagcatgtcctgcttccgtttttcataaattaatctgggtgttgggggtagtgggaggagaacggtcagaatcaaagtgacattctaagaaaaactgtaccttagagattttcctctagtgctcaaacaaatacaaaataagatccccaaggtttaaactgcccagttagcattctgacattctaaaagccggcaaagcagcttttagtggataaatgggaatggaaacgtgtgtgttcctccaaattttctagtatgatcggtgagctgttttgtaaagaagcctcatattacagagttgcttttgcacctaaatttagaattgtattccatgaactgttcctcccttttctctgcttttctcctctctgttcctcttttaataccacacgtctgttgcttgcatttagtttgtcttcttccttcagctgtgtatcccagactgttaatacagaaaagagacatttcagctgtgattatgaccattgtttcatattccaattaaaaaaagaacagcagcctagctacttaaggtggggatttcatagttccaaagaagatttagcagattagagtgagttcacacttttcaggtgccactgtaaggttctctcagcctgggaaactatcaactctttctttaaaaagaaagagggttgaaaatcctctggacgaacagaagtcactttggctgttcagtaaggccaatgttaacaacacgtttagaggaggaaaagttcaacctcaagttaaatggtttgacttattcttcgtatcattagaagaaccccagagatagcattcctctattttattttactttcttttggattgcactgattgtttttgtgggaatgacactttatctggcaaagtaactgagagtttggtaaaagaatattttcttctctgaataataattattttcacagtgaaaatttcagtattttatcactaatgtatgagcaatgatctatatcaatttcaaggcacgtgaaaaaaattttttagtatgtgcaatttaatatagaaagatttctgcctgtttggacaataggttttgggtagtacagattaggataagtaagcttatatatgcacagagattattgtattacctgtaaattgatttacaagtacttaaaagcgtggtccccagtgaggccaagaaagtttccggttaagttctttaataataatcctacagtttatcttaagaa

SEQ ID NO: 623 - DNA, 3615 bp, Homo sapiens
ggactgtgtgtgtctggctgtagcagacgcgaggcggcgacgaggcgccggggacccgcgcgaggggcggccgggaggcggcggcggcggccgccagaagtagcagcaggaccggcggcggcgacggcagccctgaaatgcattttcctctccagcggccatgttaaccaggaaaccttcggccgccgctcccgccgcctacccgaccggccgaggtggggacagcgccgttcgtcagcttcaggcttccccggggctcggtgcagggcccacccggagcggagtggggactggcccgccctcccccatcgccctgccgcctctccgggccagcaacgctgccgccgcagcccacacgattggcggcagtaagcacacaatgaatgatcacctgcatgtcggcagccacgctcacggacagatccaggttcaacagttgtttgaggataacagtaacaagcggacagtgctcacgacacaaccaaatgggcttacaacagtgggcaaaacgggcttgccagtggtgccagagcggcagctggacagcattcatagacggcaggggagctccacctctctaaagtccatggaaggcatggggaaggtgaaagccacccccatgacacctgaacaagcaatgaagcaatacatgcaaaaactcacagccttcgaacaccatgagattttcagctaccctgaaatatatttcttgggtctaaatgctaagaagcgccagggcatgacaggtgggcccaacaatggtggctatgatgatgaccagggatcatatgtgcaggtgccccacgatcacgtggcttacaggtatgaggtcctcaaggtcattgggaaggggagctttgggcaggtggtcaaggcctacgatcacaaagtccaccagcacgtggccctaaagatggtgcggaatgagaagcgcttccaccggcaagcagcggaggagatccgaatcctggaacacctgcggaagcaggacaaggataacacaatgaatgtcatccatatgctggagaatttcaccttccgcaaccacatctgcatgacgtttgagctgctgagcatgaacctctatgagctcatcaagaagaataaattccagggcttcagtctgcctttggttcgcaagtttgcccactcgattctgcagtgcttggatgctttgcacaaaaacagaataattcactgtgaccttaagcccgagaacattttgttaaagcagcagggtagaagcggtattaaagtaattgattttggctccagttgttacgagcatcagcgtgtctacacgtacatccagtcgcgtttttaccgggctccagaagtgatccttggggccaggtatggcatgcccattgatatgtggagcctgggctgcattttagcagagctcctgacgggttaccccctcttgcctggggaagatgaaggggaccagctggcctgtatgattgaactgttgggcatgccctcacagaaactgctggatgcatccaaacgagccaaaaattttgtgagctccaagggttatccccgttactgcactgtcacgactctctcagatggctctgtggtcctaaacggaggccgttcccggagggggaaactgaggggcccaccggagagcagagagtgggggaacgcgctgaaggggtgtgatgatccccttttccttgacttcttaaaacagtgtttagagtgggatcctgcagtgcgcatgaccccaggccaggctttgcggcacccctggctgaggaggcggttgccaaagcctcccaccggggagaaaacgtcagtgaaaaggataactgagagcaccggtgctatcacatctatatccaagttacctccaccttctagctcagcttccaaactgaggactaatttggcgcagatgacagatgccaatgggaatattcagcagaggacagtgttgccaaaacttgttagctgagctcacgtcccctgatgctggtaacctgaaagatacgacattgctgagccttactgggttgaaaaggagtagctcagacctgtttttatttgctcaataactctactcatttgtatcttttcagcacttaattttaatgtaagaaagttgttcattttgtttttataaaatacatgaggacaatgctttaagtttttatactttcagaaactttttgtgttctaaaagtacaatgagccttactgtatttagtgtggcagaataataacatcagtggcaggccactgattacttcatgactgccacgcatttacagattggtgtcaaagacattcactatgtttttatggttcatgttatatcctccccagggtgacagccccttaaggccctccttttccctccatgctccaggtccatgcacaggtgtagcatgtcctgcttccgtttttcataaattaatctgggtgttgggggtagtgggaggagaacggtcagaatcaaagtgacattctaagaaaaactgtaccttagagattttcctctagtgctcaaacaaatacaaaataagatccccaaggtttaaactgcccagttagcattctgacattctaaaagccggcaaagcagcttttagtggataaatgggaatggaaacgtgtgtgttcctccaaattttctagtatgatcggtgagctgttttgtaaagaagcctcatattacagagttgcttttgcacctaaatttagaattgtattccatgaactgttcctcccttttctctgcttttctcctctctgttcctcttttaataccacacgtctgttgcttgcatttagtttgtcttcttccttcagctgtgtatcccagactgttaatacagaaaagagacatttcagctgtgattatgaccattgtttcatattccaattaaaaaaagaacagcagcctagctacttaaggtggggatttcatagttccaaagaagatttagcagattagagtgagttcacacttttcaggtgccactgtaaggttctctcagcctgggaaactatcaactctttctttaaaaagaaagagggttgaaaatcctctggacgaacagaagtcactttggctgttcagtaaggccaatgttaacaacacgtttagaggaggaaaagttcaacctcaagttaaatggtttgacttattcttcgtatcattagaagaaccccagagatagcattcctctattttattttactttcttttggattgcactgattgtttttgtgggaatgacactttatctggcaaagtaactgagagtttggtaaaagaatattttcttctctgaataataattattttcacagtgaaaatttcagtattttatcactaatgtatgagcaatgatctatatcaatttcaaggcacgtgaaaaaaattttttagtatgtgcaatttaatatagaaagatttctgcctgtttggacaataggttttgggtagtacagattaggataagtaagcttatatatgcacagagattattgtattacctgtaaattgatttacaagtacttaaaagcgtggtccccagtgaggccaagaaagtttccggttaagttctttaataataatcctacagtttatcttaagaa

SEQ ID NO: 624 - DNA, 1975 bp, Homo sapiens
agcggcgcggcagcggcaggaccgccgtggcgcctagagtagcgacccggggggagcgcggggcgacgctggctgcagggacccggtgacagcgtgagaggttcgcagagtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataaaaaaaaaaaaaa

SEQ ID NO: 625 - DNA, 2324 bp, Homo sapiens
  misc_feature 1150, 1393, 1401: n = A,T,C or G
ctggcttacagggcggcggcggggtgtgtgtcctctgttaagagtgctactcgcccggggttgatctgtgcatgccactcctgggtcagacggtgaggtcggcgtctgcgaggacgcggcggtggagtagaagggcagccggagacaggcccggcgcctcttccgaggctagacggccccagcttcgcggggatcatggcattgtggtggaccgagtgcggggccactggcgaatcgccgcgggttcctgttcaacctgctggtgtccatctgcattgtgttcctcaacaaatggatttatgtgtaccacgggcttccccaacatgagcctgaccctggtgcacttcgtggtcacctggctgggcttgtatatctgccagaagctggacatctttgcccccaaaagtctaccgccctccaggctcctcctcctggccctcagcttctgtggctttgtggtcttcactaacctttctctgcagaacaacaccataggcacctatcagctggccaaggccatgaccacgccggtgatcatagccatccagaccttctgctaccagaaaaccttctccaccagaatccagctcacgctgattcctataactttaggtgtaatcctaaattcttattacgatgtgaagtttaatttccttggaatggtgtttgctgctcttggtgttttagttacatccctttatcaagtgtgggtaggagccaaacagcatgaattacaagtgaactcaatgcagctgctgtactaccaggctccgatgtcatctgccatgttgctggttgctgtgcccttctttgagccagtgtttggagaaggaggaatatttggtccctggtcagtttctgctttgcttatggtgctgctatctggagtaatagctttcatggtgaacttatcaatttattggatcattgggaacacttcacctgtcacctataacatgttcggacacttcaagttctgcattgctttattcggaggatatgttttatttaaggatccactgtccattaatcaggcccttgacattttatgtacattatttggcattctcgcctatacccactttaagctcagtgaacaggaaggaagtaggagtaaactggcacaacgtccctaattgggttttttgtnggagaaaaaaatgttgtcccaagaagataaaaaatattgttaagtgtgccagttatttaaaaaaagaaaattgggccaggcacggtggctcacgcctgtaatcccagcactttgggaggccaaggccagcggatcacttgaggtcaggagttcgagaccagcctgaccaacatggagaaaccctgtctcaactaataatacaaaattagccaggcgtggtggggcatgcctgtaatcccagcnactcgccnggctgaggcaggagaatcacttgaacccgggaggaggaggttgcactgagccgagatcgtaccattgcactccagcctgggcaacaagagcgaaactccatttcaaaaaaaaaaaattggtgacagactcaatgatggaatgatttgtcggaattaacacaaagcagattttattcatataatgactttttttaagagtctctttttttaaaaaacttaattctctaaaccgaaatggttcatgcttcttttaaaaatgattgtataaaatgtatgaatggttagcctggtgtggtggtgcacacctgtaatcccagctacttgggagactgagacatgagaatcgcttgagcctgggagcgcaggttgcaatgagccaagatcgtaccactgcactccagcctgggcgacagagcaagacactgtctctctctctctctccatatatatgtgtgtgtgtgtgtgtatatatatatgtatgtgtgtgggtgtgtgtataccatgtatccacatatatacacacacacatacatatacatgtgtatatatataccatcccatatatatgtgggatatatatatatatatatatggatatggttatatatatgggatggtttggttggtcccagcaaagtatatgaaaattaaagttctgtgataatgacaaaggaattgctgttactgtactgcaaatatgctgtgggttctcggtgttcaaactcttctaaggaaggacacacagtagctctctgcttgctgatagatggtttcccagtgtgagatttgttattttgatcagagtattcaaatcagaatttaaatctagtgtttctattttagtttagcttcctgatttatataaatgaaatctcgatttataaagtataataaagatgactgtaagacaaaaaaaaaaaaaa

SEQ ID NO: 626 - DNA, 1404 bp, Homo sapiens
cggcgttctccacctgcgcgggcctgaatggccttcaggagcacagtcggcctgaggagttgacggttactcaccgccgtgagcccaagtaactcgccctccttcggctagaaaccctccgcctgggcccgcgcgacaggagcgcggtctctgaggggagcggcgaccccgccagccccggtctctttccctggcggcggcggcttcttccgtgggacaatatgttcaagagaatggccgaatttgggcctgactccggcgggagagtaaagggtgttactatcgttaaaccaatagtttacggtaatgttgctcggtattttggaaagaaaagagaagaagatgggcacactcatcagtggacagtatatgtgaaaccatatagaaatgaggatatgtcagcatatgtgaagaaaatccagtttaaattacatgaaagctatggcaatcctttaagagttgttactaaacctccatatgaaattactgaaacaggatggggtgaattcgaaataatcatcaaaatatttttcattgaccctaatgaaagacctgtaaccctgtatcatttgctaaagctgtttcaatcagacaccaatgcaatgctggggaaaaagacagtggtttcagagttctatgatgaaatgatatttcaagacccaacagcaatgatgcaacaattattgacaacatctcgtcagctaacattaggagcctataagcatgaaacagaatttgcagagcttgaagtgaaaaccagagaaaaattagaagctgctaagaaaaaaacaagctttgagattgcagagcttaaggagagattaaaagcaagtcgtgaaactataaattgtttaaaaaatgaaatcagaaaacttgaagaagatgaccaagcaaaagacatataaacagttctcatgagaacttggtagtaagctaaactgaaaataaggtgggcttcactggagaaatggacttactgcaaatgctgtgatgtttcttagaggaacttcatatacagctgttgaccatgaatttcttagcaataggaatttgtactatttaagcaatctttaatggaaaatatgtgtgtaagaatggatgctatataggtattttaccaacccattttaagaaaattctatgatattaagcacagtttttaaaaatgtttattgtagtatatgtatagcttattacccttttgacaggcatcaaaatttcattataaagtattacttgtacaaattttgtacttctttagtggctagaattagtgaagaaacttaatgtgtatatttaatttcttcaagttcttacctgcccccatccttttttgtatatgatgtgtccagtaagtattcaataaatgtagtttacagatcctaaaaaaaaaaaaaaaaaaaa

SEQ ID NO: 627 - DNA, 1935 bp, Homo sapiens
ctggtcccgagcacgagctgtgaggggattcacttgtgtgcggaactcctcggaaccatggcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaggagttcatttcgcatactgggcattaaaataaaaatttgaacaatgaaaggaaaaaaaggagaaaaaaaaaa

SEQ ID NO: 628 - DNA, 4613 bp, Homo sapiens
atgaagatggcggacgcgaagcagaagcggaacgagcagctgaaacgctggatcggctccgagacggacctcgagcctccggtggtgaagcgccagaagaccaaggtgaagttcgacgatggcgccgtcttcctggctgcttgctccagcggcgacacggacgaggtcctcaagctgctgcaccgcggcgccgacatcaattacgccaatgtggacggactcactgccctgcaccaggcttgcattgatgacaatgttgatatggtgaagtttctggtagaaaatggagcaaatattaatcaacctgataatgaaggctggataccactacatgcagcagcttcctgtggatatcttgatattgcagagtttttgattggtcaaggagcacatgtaggggctgtcaacagtgaaggagatacacctttagatattgcggaggaggaggcaatggaagagctacttcaaaatgaagttaatcggcaaggggttgatatagaagcagctcgaaaggaagaagaacggatcatgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagagggagaaaaaagagaagaggagaaagaaggagaagataaatcacaacctaaatcaatcagagaacgacgacgaccaagagagaaaagaagatctacaggagtttcattttggacacaagatagtgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataaaaaaaaaaaagcagcaagtaatggaattgcacatattagtaacccagtggaccataattggcagtcactggaagtctgggaagaatccttggagactgtcattttcggatatcctgccaaatgccctcttatctagaatttttgtttcattttgtttaattttctggggtgtttttgttgttgttggtttgttttttgtttttttttttaatcaagaccattgtttcatgttaatgcagctgctgagaagatttttttttaatgactgagaaaacttgtttacagctccagcatataaggaaagtgttcaaggccagatatgcctcagatatttaaccagtaagccttagttgtacataaatacttttgtgtcaacaaaaactttcagctctcacagaagacagttactcaacattttttgatgtgccacagtttcgagtttttcgatatttaaattttttggcttttcatctaagtttgggtttgtattttttccttctaaactcttcatgtggcagagtcttctatgttttcacggctttttcattacagaaaagaacacttgctcttctgtgattattgtcatgtattaggctaatgctgtgttgtctcccacctggaactgaattgcttggtggaacatatgctttcactgtttgtgcaatatgcatttatttcttatatgaatgctttaaagtcatttgaggttagatcttttaattcctattttctgcttcattggtcactttttttttattgtagtataagatgttagattctgtaatcttcacattcattttagcaggtactgagtgatgctgtatatacaaataagtgtattgttttgatttttagaccaccacatggcatgcttgactatttcttatttcaaatgtctgctaatgcagagtaggctactccatgatagtgttaaaaaacaaaatttgctaacaatgtgatataaagactttaaaagttacacattatgtggagccctatctttacaaaagtttcctactgtaaagtgcttttattttcagttttcatttgatagtactcaaccataattaaagttgcataagataattgctttacatttcacatacctatatttatctgagtgctgtctaaaactgttgtgctagccaaagtaatgctatgaaatcatttgcagaattaacccgtgagttaatgttaaatgcactgttattgccatgtgaagaggcatcgactttgataccaccatcatgttcagaccattttatacatttcagtggcctttttttttttaaggaaaaaaaagcgcaaaaccaagtacatagtgacgatggcttttatttggacaaatagcttttatattttcattaaaccatgcaaaaaatactacatctttctggcacataactgtctccttaaccactggaacagttcagccatttgaataaattgtacattgtaaagcttatagtagctgattgtattattgattgtattgtatactatattaaatgtgaatttgt

SEQ ID NO: 629 - DNA, 1066 bp, Homo sapiens
ggcagttagtcggctgcaatggcgccggtgaggcggtccgcgaagtggcggcctggtggtattgaggcgcgtggtgaaggggtttccactgtcgggtacaggaataagaatgtgagacagaagacatggcggcctaaccacccgcaagccttcgtggggagcgttcgcgagggacaaggctttgcttttcgaagaaaactgaaaatacagcaaagttacaagaaattgctacggaaggaaaagaaggctcaaacgtcactggaatctcaattcacagatcgatacccagataatctgaaacatctctatttagctgaagaggaaagacataggaagcaagcaagaaaagtcgaccatcctttgtcagaacaagttcaccagccgttgcttgaagaacagtgtagcattgacgagcctttatttgaagatcagtgtagctttgaccagcctcagccagaagaacaatgtattaaaacagtaaactcctttacaatttcaaagaaaaataaaaagaaaacatcaaatcaaaaagcacaagaagaatatgaacagatacaagccaaacgtgctgctaagaaacaagaattcgagaggagaaaacaggagagagaagaagcccaaaggcagtacaaaaagaagaaaatggaagtgtttaaaatactgaacaaaaagactaaaaagggccaaccaaacttgaatgtacaaatggagtaccttcttcaaaaaatacaagaaaaatgttaaacattttgttcctacaggttaaaatatctgctgcctattaggttcttctgtgacatgtgcctcccagcagtgaactaaatttgtcgacataaactggattgctaaactatgctaaatataagatgttcacatatttttattatggtaaaaaattttctaaatatgttctacatgtttcttatttatttgcctctgaaggaaggttggcctgaagaactgaaagaacctcttattttgcaagacaggcccaagcatgtaatacttttgtaccatatgagatttatatgaaataaattttttaaaaataaggaaaaaaaaaaaa

SEQ ID NO: 630 - DNA, 2719 bp, Homo sapiens
atttgaagtcctcgttccacgccttctcatcatcctgaacaccgagctctgggactccggcggagaatctaaacgtaaagcatcacccacggtcgtgaactgtaggctctcctggcatccgggatcttattctggccttggcggagttggggatggtgtcgcctagcagccgctgccgctttggcttgctcgggaccatttggctggacccagagtccgcgtggaaccgcgatagggatctgtcagggcccgcggccgggtccagcttggtggttgcggtagtgagaggcctccgctggttgccaggcttggtctagaggtggagcacagtgaaagaattcaagatgccacctaatataaactggaaagaaataatgaaagttgacccagatgacctgccccgtcaagaagaactggcagataatttattgatttccttatccaaggtggaagtaaatgagctaaaaagtgaaaagcaagaaaatgtgatacaccttttcagaattactcagtcactaatgaagatgaaagctcaagaagtggagctggctttggaagaagtagaaaaagctggagaagaacaagcaaaatttgaaaatcaattaaaaactaaagtaatgaaactggaaaatgaactggagatggctcagcagtctgcaggtggacgagatactcggtttttacgtaatgaaatttgccaacttgaaaaacaattagaacaaaaagatagagaattggaggacatggaaaaggagttggagaaagagaagaaagttaatgagcaattggctcttcgaaatgaggaggcagaaaatgaaaacagcaaattaagaagagagaacaaacgtctaaagaaaaagaatgaacaactttgtcaggatattattgactaccagaaacaaatagattcacagaaagaaacacttttatcaagaagaggggaagacagtgactaccgatcacagttgtctaaaaaaaactatgagcttatccaatatcttgatgaaattcagactttaacagaagctaatgagaaaattgaagttcagaatcaagaaatgagaaaaaatttagaagagtctgtacaggaaatggagaagatgactgatgaatataatagaatgaaagctattgtgcatcagacagataatgtaatagatcagttaaaaaaagaaaacgatcattatcaacttcaagtgcaggagcttacagatcttctgaaatcaaaaaatgaagaagatgatccaattatggtagctgtcaatgcaaaagtagaagaatggaagctaattttgtcttctaaagatgatgaaattattgagtatcagcaaatgttacataacctaagggagaaacttaagaatgctcagcttgatgctgataaaagtaatgttatggctctacagcagggtatacaggaacgagacagtcaaattaagatgctcaccgaacaagtagaacaatatacaaaagaaatggaaaagaatacttgtattattgaagatttgaaaaatgagctccaaagaaacaaaggtgcttcaaccctttctcaacagactcatatgaaaattcagtcaacgttagacattttaaaagagaaaactaaagaggctgagagaacagctgaactggctgaggctgatgctagggaaaaggataaagaattagttgaggctctgaagaggttaaaagattatgaatcgggagtatatggtttagaagatgctgtcgttgaaataaagaattgtaaaaaccaaattaaaataagagatcgagagattgaaatattaacaaaggaaatcaataaacttgaattgaagatcagtgatttccttgatgaaaatgaggcacttagagagcgtgtgggccttgaaccaaagacaatgattgatttaactgaatttagaaatagcaaacacttaaaacagcagcagtacagagctgaaaaccagattcttttgaaagagattgaatgtctagaggaagaacgacttgatctgaaaaaaaaaaattcgtcaaatggctcaagaaagaggaaaaagaagtgcaacttcaggattaaccactgaggacctgaacctaactgaaaacatttctcaaggagatagaataagtgaaagaaaattggatttattgagcctcaaaaatatgagtgaagcacaatcaaagaatgaatttctttcaagagaactaattgaaaaagaaagagatttagaaaggagtaggacagtgatagccaaatttcagaataaattaaaagaattagttgaagaaaataagcaacttgaagaaggtatgaaagaaatattgcaagcaattaaggaaatgcagaaagatcctgatgttaaaggaggagaaacatctctaattatccctagcctcgaaagactagttaatgctatagaatcaaagaatgcagaaggaatctttgatgcgagtctgcatttgaaagcccaagttgatcagcttaccggaagaaatgaagaattaagacaggggctcagggaatctcggaaagaggctataaattattcacagcagttggcaaaagctaatttaaagatagaccatcttgaaaaagaaactagtcttttacgacaatcagaaggatcgaatgttgtttttaaaggaattgacttacctgatgggatagcaccatctagtgccagtatcattaattctcagaatgaatatttaatacatttgttacaggaactag

SEQ ID NO: 631 - DNA, 1405 bp, Homo sapiens
ccgcctcgcgccgagactagaagcgctgcgggaagcagggacagtggagagggcgctgcgctcgggctacccaatgcgtggactatctgccgccgctgttcgtgcaatatgctggagctccagaacagctaaacggagtcgccacaccactgtttgtgctggatcgcagcgctgcctttccttatgaagaagacacaaacttggattctcacttgcatttatcttcagctgctcctatttaatcctctcgtcaaaactgaagggatctgcaggaatcgtgtgactaataatgtaaaagacgtcactaaattggtggcaaatcttccaaaagactacatgataaccctcaaatatgtccccgggatggatgttttgccaagtcattgttggataagcgagatggtagtacaattgtcagacagcttgactgatcttctggacaagttttcaaatatttctgaaggcttgagtaattattccatcatagacaaacttgtgaatatagtcgatgaccttgtggagtgcgtcaaagaaaactcatctaaggatctaaaaaaatcattcaagagcccagaacccaggctctttactcctgaagaattctttagaatttttaatagatccattgatgccttcaaggactttgtagtggcatctgaaactagtgattgtgtggtttcttcaacattaagtcctgagaaagattccagagtcagtgtcacaaaaccatttatgttaccccctgttgcagccagctcccttaggaatgacagcagtagcagtaataggaaggccaaaaatccccctggagactccagcctacactgggcagccatggcattgccagcattgttttctcttataattggctttgcttttggagccttatactggaagaagagacagccaagtcttacaagggcagttgaaaatatacaaattaatgaagaggataatgagataagtatgttgcaagagaaagagagagagtttcaagaagtgtaaattgtggcttgtatcaacactgttactttcgtacattggctggtaacagttcatgtttgcttcataaatgaagcagctttaaacaaattcatattctgtctggagtgacagaccacatctttatctgttcttgctacccatgactttatatggatgattcagaaattggaacagaatgttttactgtgaaactggcactgaattaatcatctataaagaagaacttgcatggagcaggactctattttaaggactgcgggacttgggtctcatttagaacttgcagctgatgttggaagagaaagcacgtgtctcagactgcatgtaccatttgcatggctccagaaatgtctaaatgctgaaaaaacacctagctttattcttcagatacaaactgcag

SEQ ID NO: 632 - DNA, 1321 bp, Homo sapiens
ccgcctcgcgccgagactagaagcgctgcgggaagcagggacagtggagagggcgctgcgctcgggctacccaatgcgtggactatctgccgccgctgttcgtgcaatatgctggagctccagaacagctaaacggagtcgccacaccactgtttgtgctggatcgcagcgctgcctttccttatgaagaagacacaaacttggattctcacttgcatttatcttcagctgctcctatttaatcctctcgtcaaaactgaagggatctgcaggaatcgtgtgactaataatgtaaaagacgtcactaaattggtggcaaatcttccaaaagactacatgataaccctcaaatatgtccccgggatggatgttttgccaagtcattgttggataagcgagatggtagtacaattgtcagacagcttgactgatcttctggacaagttttcaaatatttctgaaggcttgagtaattattccatcatagacaaacttgtgaatatagtcgatgaccttgtggagtgcgtcaaagaaaactcatctaaggatctaaaaaaatcattcaagagcccagaacccaggctctttactcctgaagaattctttagaatttttaatagatccattgatgccttcaaggactttgtagtggcatctgaaactagtgattgtgtggtttcttcaacattaagtcctgagaaagggaaggccaaaaatccccctggagactccagcctacactgggcagccatggcattgccagcattgttttctcttataattggctttgcttttggagccttatactggaagaagagacagccaagtcttacaagggcagttgaaaatatacaaattaatgaagaggataatgagataagtatgttgcaagagaaagagagagagtttcaagaagtgtaaattgtggcttgtatcaacactgttactttcgtacattggctggtaacagttcatgtttgcttcataaatgaagcagctttaaacaaattcatattctgtctggagtgacagaccacatctttatctgttcttgctacccatgactttatatggatgattcagaaattggaacagaatgttttactgtgaaactggcactgaattaatcatctataaagaagaacttgcatggagcaggactctattttaaggactgcgggacttgggtctcatttagaacttgcagctgatgttggaagagaaagcacgtgtctcagactgcatgtaccatttgcatggctccagaaatgtctaaatgctgaaaaaacacctagctttattcttcagatacaaactgcag

SEQ ID NO: 633 - DNA, 2842 bp, Homo sapiens
gagacgctcgctgtttgtatccattgaggagctgcctcgcgcagggggtgtgcgaggctgagtccaagagatagcaaatcgagtcttaaataatccggggagaaagacgcccgggtagatttgaggtgcagccttggagggagggattagaagccgctagactttttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcggtgctcgggctgctgctcaagaagctcaaggacgagggctgccgggcgttctacctggaaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaaaaagaaagaataaaaaaaccttcagctgtgctaaacagtatattacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcgtggtgtaaagtttagagctggaatttattataagaatgtaaaaccttaaattattaataaataactattttggctattgaaaaaaaaaaaaaaaaaaaaaaaa

SEQ ID NO: 634 - DNA, 2404 bp, Homo sapiens
gagacgctcgctgtttgtatccattgaggagctgcctcgcgcagggggtgtgcgaggctgagtccaagagatagcaaatcgagtcttaaataatccggggagaaagacgcccgggtagatttgaggtgcagccttggagggagggattagaagccgctagactttttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcggtgctcgggctgctgctcaagaagctcaaggacgagggctgccgggcgttctacctggaagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaaaaagaaagaataaaaaaaccttcagctgtgctaaacagtatattacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcgtggtgtaaagtttagagctggaatttattataagaatgtaaaaccttaaattattaataaataactattttggctattgaaaaaaaaaaaaaaaaaaaaaaaa

SEQ ID NO: 635 - DNA, 4398 bp, Homo sapiens
ggccaaaggtcaagatacttctctgggaaatgttgctgctgatgctgctttacaaagtcatacaatgagtgtttggtttaagaaagattttcatacttaaaagattttcatcttggaaatacatcaagtgaaaattaaattcttttgggaaacattttccttctgatatattatacttgtaatgggcgacatggcaaacaactcagttgcttacagtggtgtgaaaaactctttgaaggaagctaatcatgatggagactttggaattacgctcgcagagctgcgggctctcatggagctcaggtccacagatgcattacgaaaaatacaggaaagctatggagatgtctatggaatttgcaccaaattgaaaacatctcccaatgaaggtttaagtggaaaccctgcagatttagaaagaagagaagcagtgtttggaaagaattttatacctcctaaaaagccaaaaacctttcttcaattagtatgggaagcattacaagatgtcactttaattatattagaaattgcagccatagtatcattgggcctttctttttatcagcctccagaaggggataatgcactttgtggagaagtttctgttggggaggaagaaggtgaaggtgaaactgggtggattgaaggagctgcaatcctcttgtctgtagtgtgtgtggtgttagtaacagctttcaatgactggagtaaggagaaacagtttagaggtttgcagagccgaattgaacaagaacagaagttcactgtcatcaggggtggtcaggtcattcagatacctgtagctgacattactgttggagatattgctcaagtgaaatatggtgatcttcttccagctgacggcatacttattcaaggcaacgatcttaaaattgatgaaagctcattgactggtgaatcagatcatgttaaaaagtctttagataaggatcccttacttctatcaggtactcatgtaagggaaggctctggaagaatggtagttacagctgtaggtgtaaattctcaaactggaattatctttaccttacttggagctggaggtgaagaggaagagaagaaagatgagaagaaaaaggaaaagaaaaataagaaacaagatggagctattgagaatcgcaacaaagcaaaagcccaggatggtgcagccatggaaatgcagccattgaagagtgaagaaggtggagatggtgatgaaaaagataaaaagaaagcaaatttgccaaaaaaggaaaaatctgttttacaagggaaacttacaaaactggctgttcagattggcaaagcaggtctgttgatgtctgccatcacagttatcattctagtattatattttgtcattgacaccttctgggttcagaaaagaccatggcttgctgagtgcacaccaatttatatacaatactttgtgaagttcttcattattggagttacagttttagtggtcgcagtgccagaaggtcttccacttgcagtcacgatctcactggcttattcagtcaaaaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattgccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtgtttcaaaatcttgagtgctaatggtgaggcaaaagtattcagaccaagggaccgtgatgatattgtaaaaactgtgattgaaccgatggcatcagaaggcttgagaaccatatgtcttgcattcagagattttccagcaggagaaccagaaccagagtgggataatgaaaatgatattgtcaccggccttacatgcattgctgttgtggggattgaagatcctgtgagacctgaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagagattgagcaagagaggatagacaagatttggccaaaacttcgagtacttgcaagatcatctcctactgataagcatacactggttaaaggtataattgacagcactgtctcagaccaacgccaggttgtagctgtaactggtgatggtacaaatgatggcccagcactaaagaaagcagatgttggatttgcaatgggtattgctggaactgatgtagctaaagaagcatccgatattattctcacagatgacaactttacaagcattgttaaagcagttatgtggggacgaaatgtctatgacagcatctcaaaattccttcagttccaacttactgttaatgtagtagcagtgattgttgcttttacgggcgcctgcattactcaagactcaccgcttaaggctgtgcagatgctgtgggtaaacctcataatggatacactcgcttccctggctctggcaacggaaccacccactgagtctctcttgcttcggaaaccttatggtagaaataagcctctcatctcacgtacaatgatgaagaatattttgggtcatgcattctatcaacttgtagtagtctttacactcttatttgctggagaaaagttttttgacattgatagtggaagaaatgctcctttgcatgctcctccttcagaacattatactattgtttttaatacctttgtgctgatgcaacttttcaacgaaataaatgcccggaaaattcatggtgaaagaaatgtattcgaaggaatctttaacaatgccatcttctgcacaattgttttaggcacttttgtggtacagataataattgtgcagtttggtggaaaacctttcagttgttcagaactttcaatagaacagtggctatggtcaatattcctaggaatgggaacattactctggggccagcttatttcaacaattccaactagccgtttaaaattcctcaaagaagctggtcatggaacacaaaaggaagaaatacctgaggaggaattagcagaggatgttgaagagattgatcacgctgaaagggagttgcggcgtggccaaatcttgtggtttagaggtctgaacagaatccaaacacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcagg

SEQ ID NO: 636 - DNA, 4398 bp, Homo sapiens; identical to SEQ ID NO: 635

SEQ ID NO: 637 - DNA, 1783 bp, Homo sapiens
cctctcggagctggaaatgcagctattgagatcttcgaatgctgcggagctggaggcggaggcagctggggaggtccgagcgatgtgaccaggccgccatcgctcgtctcttcctctctcctgccgcctcctgtgtcgaaaataacttttttagtctaaagaaagaaagacaaaagtagtcgtccgcccctcacgccctctcttcctctcagccttccgcccggtgaggaagcccggggtggctgctccgccgtcggggccgcgccgccgagccccagcgccccgggccgcccccgcacgccgcccccatgcatcccttctacacccgggccgccaccatgataggcgagatcgccgccgccgtgtccttcatctccaagtttctccgcaccaaggggctgacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatccataaatttgatttttgctttgggtgggctcctcttggggatggattatggaatttaaaccatgtcacagctgtgaagatctggcacaagatagaatggtaaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcatttttaacc

SEQ ID NO: 638 - DNA, 1126 bp, Homo sapiens
gttctgcggtgctggtatttagagcgcagcggctgacgggccggatcgccttcgccgccgcccgcccgcaaaccttcgtgcccggcccgtcctcgcccccgcctccgccaccgcctcggcccgcagagcttgccccctccccacccgcagacatgtccgagtccaagagcggccccgagtatgcttcgtttttcgccgtcatgggcgcctcggccgccatggtcttcagcgccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtagaccctctccgagcccaccagccacagaatattatgtaaagaccacccctcctcattccagaacgaacagcctgacacatacgcacggggccgccgcccccagtagttggtcttgtacatgcgcagtgtcctagtgcccatcgtctgtttccccggccttgcccccgcccgccccgtgccgtggacatctgggcccactcatcgcccctccaggcccccggcgccccaccccctagagtgctctgtgtatgcggatgatttagaattgtcatttctctttactggatgtttatttataaagatctggcctgttcctgcgtctgcggagcggcccttgtctcccagctatctataaccttagctagagtgtcgccttgtgggttcctgttgctgagacttcctggatggagccgccctcaccgccgggcccgtggccctgcgcggagctgtgtccaataaagttcttggatgtgaaaaaaaaaaaaaaaaaaaaaaaaaaaaaaaaaa

SEQ ID NO: 639 - DNA, 1126 bp, Homo sapiens; identical to SEQ ID NO: 638

SEQ ID NO: 640 - DNA, 1540 bp, Homo sapiens
ctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctagggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggtgagcgccctgacccactgggtcccaggtcccagcccgcatgccaggtggcccacgacccccccagagcctgccctctctgctctcaaggcaccaagacgctgagtggcagcatagccccaatggacgtctgtgtccggcacttcctgcaggccacaggctgcagcatggagtcggccctggaggctgcatccctgcaccccgcccagttgctggggctggagaagagtaaggggaccctggactttggtgctgacgcagacttcgtggtgctcgacgactcccttcacgtccaggccacctacatctcgggtgagctggtgtggcaggcggacgcagctaggcagtgacaaggacctcggctgagaggacacctggccgcagcgggatgccatcagggccgggtggttggggagctggtctccagggagtgagtcgggagccctgctggattgatgcccagggcctgtgcggccgccctggaggcggtggctgggataaacgtgcacccagcaggaaaaaaaaaaaaaaaaaaaa

SEQ ID NO: 641 - DNA, 1891 bp, Homo sapiens; identical to SEQ ID NO: 33

SEQ ID NO: 642 - DNA, 1891 bp, Homo sapiens; identical to SEQ ID NO: 33

SEQ ID NO: 643 - DNA, 9027 bp, Homo sapiens
gcggcccaggcggggtgcgagtggcgcagtcggagcccgttgcggcccctgaggaagcgaggaggcgtcggcgtcggctgaggcgggcggaccggcgaggcgaggcggcggccccaggcccgagggactcgggagctcgagcagcggcggcggcaagacctctccccctcggaggcggcgggcggaggcggcgggagcggtggtgccccccccgggcacggggccatgtacaacgggatcgggctgccgacgccccggggcagcggcaccaacggctacgtccagcgcaacctgtccctggtgcggggccgccggggtgagcggcctgactacaagggagaggaggaactgcggcgcctggaggctgccctggtgaagcggcctaatcctgacatcctggaccacgagcgcaagcggcgcgtcgagctgcgatgcctcgagctggaggagatgatggaagagcaggggtacgaggaacagcaaattcaggaaaaagtggcgacctttcgactcatgttgctggagaaggatgtgaaccctgggggcaaggaggagaccccagggcagaggccagcggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacagccttgttcgggagtctagcagttctcgctcaccaaccccaaagcagaagaagaagaaaaagaagaaagatagaggacgcaggtcagagagcagctctcctcgacgggagagaaagaaaagctcaaagaagaagaagcacaggtcagaatctgagtccaagaaacgtaagcataggtctcccactccaaagagcaaacgtaaatctaaggacaaaaagcgaaagcggtctcgaagtacaacaccagcccccaagagccgccgggcccaccgttcaacttctgctgactctgcttcctcctccgatacttcccgcagtcggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggagaaatctgcaactcgacctagcccctctccggaaaggagcagcacaggcccagaaccacctgctcccactccgctccttgctgagcgacatggcggctccccacaaccccttgcaaccacccccttaagccaggagccagtgaaccccccatctgaggcctctccaactcgggaccgttcaccacctaagtctcccgagaaacttccccagtcttcttcctcagagagcagcccaccatcccctcaacctaccaaagtttctcggcatgccagctcttccccagaaagtcctaaacctgctccagctccagggtcccaccgagagatttcttcttctcccacatctaagaatcgctcacatggccgagcaaaacgggataaatcacattctcataccccctcccgtaggatggggaggtcccgtagccctgccaccgctaagagagggcgatctcggtctcgaacccctaccaagagaggtcattctcgatcccgatctccccagtggcgtaggtccaggtctgcacagaggtggggaagatctagaagcccccagcgacgtggccgctctaggtctcctcagcgaccaggctggtctaggagcagaaatacccagagaagaggcaggtctaggtcagcaaggcgagggaggtcccactctagatccccagccactaggggtagatctcgttctagaacaccagcccgccggggcaggtcccgctctagaacacctgccaggcggagatcacgatccagaactcccaccaggcgtaggtctcggtctagaacaccagcccggaggggcaggtctcggtctagaacacctgctaggcgcagatctaggacccgatcaccagtacgacgcaggtctcgtagtagatcaccagccaggagaagtggcaggtcacgctctagaaccccagctagacgtggccgctcacgctccagaaccccagccagacgtggccgctcacgctctagaaccccagctagacgcagtggtcgctcacgctccagaacaccagccaggagagggaggtctcggtctaggacaccaagacgaggaagatcccgcagtagaagcttagttagacgtggaagatctcactctagaacacctcaaagaagaggcagatctggctcatcttcagagcggaaaaacaaatccagaacatctcaaagaagaagcaggtccaattcaagcccagaaatgaagaaatctcgcatttcttcaaggcggagcaggtctctctcttcaccacggtccaaagcaaaatctcgcttgtctttgaggcgcagcctttcagggtcttccccatgccctaagcaaaagtcacagacaccacccaggcgcagtcgctctggatcctcccaacctaaagctaaatctagaacgccacccagacgcagtcgctccagttcttctccgccacctaaacagaaatctaagacaccatcaagacaaagtcattccagttcatctcctcatcctaaagtgaaatctggaacaccaccgaggcaagggtccataacaagtccccaggccaatgagcaatctgtaacgccacagagacggagctgttttgaatcatcacctgaccctgagttgaaatctaggaccccttctagacatagctgctcagggtcctctcctcctagagtgaaatctagcacacctcccagacagagcccatctaggtcatcatctccacaacccaaagtgaaggcaataatatcaccaagacaaagaagccattctggctcctcttctccaagtcctagtagggtgacgtcgagaacaactccacggcgaagcagatcagtatctccctgctccaatgtggaatccagattgttgccaagatacagtcattctgggtcctcctcaccagataccaaagtgaaacctgaaacaccgccaagacaaagtcactcagggtctatttcaccataccccaaagtaaaggcccaaactccaccggggccaagtctttctggatcaaagtcaccatgtccccaagagaagtctaaagactcactagttcaaagttgccctggatccctctctctctgtgcaggagtaaaatctagcacaccaccaggcgagagctattttggtgtctcatctctgcaactgaaaggacaatctcaaacttcaccagaccacagatctgatacttcaagtccagaagtgagacagagtcattcagaatcaccatctctgcagagcaaatctcaaacatcacctaagggaggtcggtccaggtcttcatctccagtcactgagctggcatccagatctccaataagacaagatagaggtgagttctcagcgagtcctatgttgaaatctggaatgtctcctgagcagagcaggttccagtctgactcttcttcatatcctacagtggactcgaattctctcttggggcagagtagattggagactgctgaatcaaaagagaaaatggccttaccccctcaggaggatgctactgcatcacctcctagacagaaagacaaatttagtccctttccagtacaggataggcctgagtcttcactggtattcaaagacacacttagaaccccgccaagagaaagaagtggtgctgggtcatctccagaaacaaaagagcaaaatagtgcattgcctacgtcaagccaagatgaagagttaatggaggtggtagagaagtctgaagaacccgcaggccaaatcctgtctcatttgtcttcagaacttaaagaaatgtccacaagtaactttgaatcatctcctgaagtagaagaaaggcctgctgtgtctttgactcttgatcagagccagtcacaggcttctttggaagcagtagaagtcccttcaatggcctcatcttggggtgggccacatttttctccagaacataaagaactgtctaactccccactcagggagaacagctttggatcacctttagaatttagaaactcaggcccacttggtacagaaatgaatactggattttcttctgaggttaaagaagatttgaatggaccgtttcttaatcagctggaaacagatccatctctagacatgaaagaacaatcgacaagatcctctggacacagcagttctgagttatccccagatgcagtggaaaaggcagggatgtcttcaaatcagagcatctcttcacctgtgcttgatgctgtacccagaacaccctcgagagaaagaagtagttctgcatcttctcctgaaatgaaagatggtttacccagaactccatcaaggagaagcaggtctgggtcttctccaggacttagagatgggtctgggactccctcgaggcacagcctgtctgggtcctctcctggaatgaaagatatacctagaacgccatttagagggagaagcgaatgtgattcttccccagaaccgaaagctttgcctcagactcctaggccgaggagtcgttctccatcatccccagagctcaacaacaagtgtcttaccccccagagagaaagaagcgggtcagaatcatcagttgatcagaaaactgtggctcggactcccctggggcagagaagtcgttcgggatcctctcaagaacttgatgtgaaacccagtgcatcccctcaggaaagaagtgagtcagactcttctccagattctaaagccaagacacgaaccccacttcggcagaggagtcggtctggatcatctccagaggttgacagcaaatctcgactatcccctcggcgcagtaggtctggttcctcccctgaagtgaaagataagccaagagcagcacccagggcacagagtggttctgattcctctcctgaacctaaagctccagcccctcgggcccttcccagacgaagcagatcaggttcatcaagcaaaggcagaggcccttctcctgaaggaagcagcagtaccgagtcctctcctgaacatccgcccaaatccagaactgctcgcagaggttccaggtcatcaccagagcccaagaccaagtctcgtacaccacctcgacgtcgcagctctcgatcatctccggagctaacaaggaaggccagactgtcccgtagaagccgctctgcctcatcctcaccagaaactcgctctagaactcccccaaggcaccggagaagtccctcagtgtcttccccggagccagccgaaaaatcgaggtcttcacgccgacggcgctcagcttcatctccacgcactaagacaacctcaaggagaggccgctctccttcgccaaagcctcgtggactccagaggtcccgttcccgctcaaggagagagaaaacaagaacaacccgacgtcgagataggtctggatcttctcagtcaacctctcggcgaagacagcggagccggtcaaggtcgcgggttactcggcggcggaggggaggctctggttatcactcaaggtcacctgcccggcaggaaagttcccggacctcctctcgacgccgaagaggccgctctcggacacccccaaccagtcggaagcgttctcgctcacgcacatcaccagccccgtggaaacgctctagatctcgagcctctccagccactcaccggcgatccaggtccagaacccccctgataagccgacgtaggtccagatctcgaacttcaccagtcagccggagacggtcaaggtccaggacttcagtgactcgacgaagatcccggtcaagagcatccccagtgagcagaaggcgatccagatccagaacgccaccagtaacccgccgtcgttcaaggtctagaacgccaacaacacgccgccgctcccgttctagaactccaccagtgactcgcagaaggtccagatccaggactccaccagtaaccaggaggcgatctcgaagcagaacttcgcctatcactcgcagaagatcaagatccagaacatctccggtcacccgaaggagatctcgatctcgcacatctccagtaactcgaagaaggtcccgctctcgaacctcaccagtgacacgccgccgctctaggtcccggacacctccagctattcggcgccgctctagatctcgaacgccactgttaccacgcaaacgttctcgaagtcgctcaccacttgctatccgccgccgctccagatcccgtactccacgaacagctcggggtaaacggtccttaacaagatctcctccagccatccgcaggcgttctgcatctggaagtagttctgatcgttcacgatctgctactcctccagcaacaagaaatcattctggttcacggacacctccagtagcactcaacagttccagaatgagctgcttcagtcgtcctagcatgtccccaacacctcttgatcgctgcagatcacctggaatgcttgaaccccttggcagctctagaacacccatgtctgtcctgcagcaagccggcggctccatgatggatggtccaggtccccgaatacctgaccaccagagaacatctgtgccagaaaatcatgctcagtccaggattgcacttgccctgacagctatcagtcttggcaccgctcggcctcctccgtccatgtctgctgctggccttgctgcaagaatgtcccaggttccagccccggtgcctctcatgagtctcagaaccgcaccagcagccaaccttgccagcaggattcctgcagcctctgcggcagccatgaacctagccagcgccaggacacctgccattccaacagcagtgaacctggctgactctcgaacgccagctgcagcagcggccatgaacttggccagccccagaacagcggtggcaccttcggctgtgaacctggctgaccctcgcactcccacagccccagctgtgaacctagcaggggccagaaccccagctgccttggcagctctgagtctcacaggctctggcacaccaccaactgctgcaaactatccctccagctccagaacaccacaggctccagcctctgcaaacctggtgggtcctcggtctgcacatgccacagctcctgtgaatattgccggctccagaaccgccgcagccttggcccccgcgagcctcaccagtgctaggatggctccagcattgtctggtgcaaacctcaccagccccagggtgcccctttctgcctacgagcgtgtcagtggcagaacctcaccaccgctccttgaccgagctaggtccagaacaccaccgtctgccccaagccaatctaggatgacctctgaacgggctccctccccttcctctagaatgggccaggctccttcacagtctcttctccctccagcacaggatcagccgaggtctcctgtgccttctgctttttcagaccaatcccgttgtttgattgcccagaccacccctgtagcagggtctcagtccctttcctctggggcagtggcaacgaccacgtcctctgctggtgatcacaatggcatgctctctgtccctgcccctggggtgccccactctgatgtgggggagccacctgcctctactggggcccagcagccttctgcattagccgccctgcagccagcaaaggagcggcggagttcctcctcgtcgtcgtcgtcctctagctcctcctcctcttcatcatcgtcgtcgtcgtcctcctcctcctctggctccagttctagtgactcagagggctctagccttcctgtgcaacctgaggtggcactgaagagggtccccagccccaccccagccccaaaggaggctgttcgagagggacgtcctccggagccaaccccagccaaacggaagaggcgctctagcagttccagttccagctcctcctcttcatcttcctcctcctcctcctcctcctcttcttcctcctcctcttcctcttcttcttcttcctcctcatcttcctcctcctcgtcgtcttcctccccttcccctgctaagcctggccctcaggccttgcccaaacctgcaagccccaagaagccaccccctggcgagcggaggtcccgcagcccccggaagccaatagactccctcagggactctcggtccctcagctactcgcctgtggagcgtcgccgtccctcgccccagccctcaccacgggaccagcagagcagcagcagtgagcggggttcccggagaggccagcgtggggacagccgctcccccagccacaagcgcaggagggagacacctagccctcggcccatgagacaccgctcctccaggtctccataaattgtctttgggggattccaccacacccaatgctctggagccacaaggagtgtcccttcttccccagcagagccgtgggagggtccttgtctgctctcctttgaaccttggcagcccttggatggagggctccctttccctccccttttttttttctttgttcctgtgaaatgttaatctccgtgagttcttcctggttcatgtgttctggggggtttggggtgggagggaatgcagatgggagttgggggaggggaggatacagttcaggataccccagcctggagtcagggccagggaggcatggccccacttgtatccagaagttcccaggggtgattgtgatggtggttgggactggaggttgtataaggtgttcttggaaggaaggggcaggagttggaattagttggtccctactgtcccccatgaggttgtgaacccctccccccaacttttcatgtttcttaaaggcattttggttttttaaaatctgtacagcaagagcaactttttctgtcaaataaaaatgagaaatgcagg

SEQ ID NO: 644 - DNA, 9027 bp, Homo sapiens; identical to SEQ ID NO: 643

SEQ ID NO: 645 - DNA, 3083 bp, Homo sapiens
atgttgtttttcctgtacctaagttcccgctgtaggtggtacctttgcagacggtgcgatgggggaagcagagaagtttcactacatctatagttgtgacctggatatcaacgtccagcttaagataggaagcttggaagggaagagagaacaaaagagttataaagctgtcctggaagacccaatgttgaagttctcaggactatatcaagagacatgctctgatctttatgttacttgtcaagtttttgcagaagggaagcctttggccttgccagtgagaacatcctacaaagcatttagtacaagatggaactggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacggcatgtttcgccaagggatgcatgacttgaaagtctggcctaatgtagaagcagatggatcagaacccacaaaaactcctggcagaacaagtagcactctctcagaagatcagatgagccgtcttgccaagctcaccaaagctcatcgacaaggacacatggtgaaagtagattggctggatagattgacatttagagaaatagaaatgataaatgagagtgaaaaacgaagttctaatttcatgtacctgatggttgaatttcgatgtgtcaagtgtgatgataaggaatatggtattgtttattatgaaaaggacggtgatgaatcatctccaattttaacaagttttgaattagtgaaagttcctgacccccagatgtctatggagaatttagttgagagcaaacaccacaagcttgcccggagtttaagaagtggaccttctgaccacgatctgaaacccaatgctgccacgagagatcagttaaatattattgtgagttatccaccaaccaagcaacttacatatgaagaacaagatcttgtttggaagtttagatattatcttacgaatcaagaaaaagccttgacaaaattcttgaaatgtgttaattgggatctacctcaagaggccaaacaggccttggaacttctgggaaaatggaagccgatggatgtagaggactccttggagctgttatcctctcattacaccaacccaactgtgaggcgttatgctgttgcccggttgcgacaggccgatgatgaggatttgttgatgtacctattacaattggtccaggctctcaaatatgaaaattttgatgatataaagaatggattggaacctaccaagaaggatagtcagagttcagtgtcagaaaatgtgtcaaattctggaataaattctgcagaaatagatagctcccaaattataaccagcccccttccttcagtctcttcacctcctcctgcatcaaaaacaaaagaagttccagatggcgaaaatctggaacaagatctctgtaccttcttgatatcgagagcctgcaaaaactcaacactggctaattatttatactggtatgtgatagtggaatgtgaagatcaagatactcagcagagagatccaaagacccatgagatgtacttgaacgtaatgagaagattcagccaagcattgttgaagggtgataagtctgtcagagttatgcgttctttgctggctgcacaacagacatttgtagatcggttggtgcatctaatgaaggcagtacaacgcgaaagtggaaatcgtaagaaaaagaatgagagactacaggcattgcttggagataatgaaaagatgaatttgtcagatgtggaacttatcccgttgcctttagaaccccaagtgaaaattagaggaataattccggaaacagctacactgtttaaaagtgcccttatgcctgcacagttgttttttaagacggaagatggaggcaaatatccagttatatttaagcatggagatgatttacgtcaagatcaacttattcttcaaatcatttcactcatggacaagctgttacggaaagaaaatctggacttgaaattgacaccttataaggtgttagccaccagtacaaaacatggcttcatgcagtttatccagtcagttcctgtggctgaagttcttgatacagagggaagcattcagaacttttttagaaaatatgcaccaagtgagaatgggccaaatgggattagtgctgaggtcatggacacttacgttaaaagctgtgctggatattgcgtgatcacctatatacttggagttggagacaggcacctggataaccttttgctaacaaaaacaggcaaactcttccacatagactttggatatattttgggtcgggatccaaagcctcttcctccaccaatgaagctgaataaagaaatggtagaaggaatggggggcacacagagtgagcagtaccaagagttccgtaaacagtgttacacggctttcctccacctgcgaaggtattctaatctgattttgaacttgttttccttgatggttgatgcaaacattccagatattgcacttgaaccagataaaactgtgaaaaaggttcaggataaattccgcttagacctgtcggatgaagaggctgtgcattacatgcagagtctgattgatgagagtgtccatgctctttttgctgcagtggtggaacagattcacaagtttgcccagtactggagaaaatgaaactgggattgacccatcaagatgcttggctcaataagaaaaccacgttaggagcaacctttgtatattggagacttcagagtaaccagcaaggaagagaaatcttaatcttcaagttaccatattttccaaatattacatggtacctgagttctgcttccttggatgtcattgcttaaatatagtcttgaagggcttgttttgaaatattgtatatattttttcaaatgtatacattgttaataaattaagaaatgagaaacattcttatttatgtacatgttatgagagttctggaggaagtaatatgttgaaatagtaaaacattttagtttttgagtttaaaaaaaaaaaaaaaaaa

SEQ ID NO: 646 - DNA, 1883 bp, Homo sapiens
gtcccagtcagtccggaggctgcggctgcagaagtaccgctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgcaaaaaaaaaaaaaaaaaaaaaaaaaaaaaaa

SEQ ID NO: 647 - DNA, 1866 bp, Homo sapiens
atggcggatttcgaagagttgaggaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccaggtttggattttctttcccttattccagttgatccccagtactgtcctcctatgtttttggatagtctcacctcacccttaacagcaagcagtacgtctgtcaccaccaccagctcccatgaaagcagtactcatgttagttcatccagcagcaggagtgagacaggggtcataaccagcagtggaagtaacattcctgaaatcatctcattggactaa

SEQ ID NO: 648 - DNA, 1719 bp, Homo sapiens
atggcggatttcgaagagttgaggaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccaggagaacaaagaagaaatgatattaataatgaactgaagcttggaacatcttctgatactgtgcaacagtga

SEQ ID NO: 649 - DNA, 1866 bp, Homo sapiens; identical to SEQ ID NO: 647

SEQ ID NO: 650 - DNA, 1719 bp, Homo sapiens; identical to SEQ ID NO: 648

SEQ ID NO: 651 - DNA, 1460 bp, Homo sapiens
aggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgtttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttaaaaagtaattactgcacataaaatgataaataggtaatttgaataattttattttaagctccttggttaattattttgtctattgtctcagctataaattcaaatttatacatactattgagtattaatattctctgatttcagggagaattctgtcagtcacatgatgattatgtttttgtttaacattctttccatgcacttgttattttattaatttgcctgaatgatgagaccagaccagtgtctacagattttcattgtcagaaaaatctataagtctgccctttttacaatgatgatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagtcaaaaaaaaaaaa

SEQ ID NO: 652 - DNA, 2650 bp, Homo sapiens
ggagaaggcgagcgcggcagtcgcgccggcgctgggcgaggaagcggagccgggccgcctccggaaaatggctccaaaggttaaatgaagcaggaaaaatacatagatgcagccttgcagcctctccagatgtttggggataatattccagatagaaatattgatcccttggattaggtaactagtcataatgaagaaaattagtcttaaaaccttacggaaatcttttaacttgaataaaagtaaagaagaaactgatttcatggtagtacaacaaccatcgctagccagtgactttggaaaagatgattccttatttggtagctgctatggtaaagatatggccagctgcgatatcaacggtgaagatgaaaaaggcggaaaaaacagatcaaaaagcgagagcctgatgggtacgctaaaaaggcggctttctgcaaaacagaagtcaaaaggcaaggcgggcacaccctctgggagctctgccgacgaggacaccttctcctcctcctcagcacccatagtctttaaagacgtgagagctcagaggccgataaggtccacgtcgctccgcagccatcactacagtcccgcgccgtggcctctgcggcccacaaactccgaggagacctgcatcaagatggaggtgagagtcaaggccttggttcactcttccagcccgagtccagccctgaatggcgtccggaaggatttccacgacctccagtctgagaccacgtgccaggagcaagccaattcactgaagagctcggcttctcataatggagacctgcatcttcacctggatgaacatgtgcctgtcgttattggacttatgcctcaggactacattcagtatactgtgcctttagatgaggggatgtatcctttggaaggatcacggagctattgtctggacagctcttctcccatggaagtctctgcggttcctcctcaagtgggagggcgcgctttccccgaggatgagagtcaggtagaccaggacctagttgtcgccccagagatcttcgtggatcagtccgtgaatggcttgttgattggcaccacgggagtcatgttgcagagcccgagagcgggtcacgatgatgtccctccactctcaccattgctacctccaatgcagaataatcaaatccaaaggaacttcagtggactcactggcacagaagcccacgtggctgaaagtatgcgctgtcatttgaattttgatccgaactctgctcctggggttgcaagagtttatgactcagtgcaaagtagtggtcccatggttgtgacaagccttacagaggagctgaaaaaacttgcaaagcaaggatggtactggggaccaatcacacgttgggaggcagaagggaagctagcaaacgtgccagatggttcttttcttgttcgggacagttctgacgaccgttaccttttaagcttgagctttcgctcccatggtaaaacacttcacactagaattgagcactcaaatggtaggtttagcttttatgaacagccagatgtggaaggacatacgtccatagttgatctaattgagcattcaatcagggactctgaaaatggagctttttgttattcaaggtctcggctgcctggatctgcaacttaccccgtcagactgaccaacccagtgtcccggttcatgcaggtgcgctcgttgcagtacctgtgtcgttttgttatacgtcagtataccagaatagacttaattcagaaactgcctttgccaaacaaaatgaaggattatttacaggagaagcactactgaaagattgagaaccctgcatcttgcactttgggaataagaacaagagattgaaatacagtttacaaactttcattgccatcaaaatcttttgctgccataactatttcagttttatgtgtaaaagagtcatcagtttgtttaggggtggggaagtgtcagcaaggtgtcttgggtttattttggttctttaaaaaagggaagtcttgaggttttagaggtgtgaattatgtttcatcaatgtgcagaataatcacaatgtgaattatcaaattctcctcaatgccccccccgcccagtcctttgctgctatccactgtgatttttatgcattaaaagcacatttcatgtgtattcaaccctaagtaaagttgaatgaaacttaacagaatggaaattgctatgtctttttaaatggtccattttcaaaagacagtgttgaataaacatacctgtgtgataaaacacagaatttacatatacactgaagatgagtttttaatctcttactttaaaaagatttatttagaatcgtgaattgacataatcttgggtaatggaacggagatctgcaacatatcttttaacaacacttttttctaaattatttctaaggttgtgctaattcttttggttgtgaaaagttgaatttttctgttgccttcgttttcatcttctagtttgtctattttaataaatggccttacattaaaaaattgtaaagaaatgtataccaccaatttagaaattgttgccttttctgtaattaaactcgggtacaaattggcataacatgaaaacctatggaactagaattattattaaagaaatattagatgaaaaaaaaaaaaaaaa

SEQ ID NO: 653 - DNA, 1231 bp, Homo sapiens
cctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtaccctggctaaagccgggccggagccctctgccctctcatgcccgcagccagcctgggctgtgcaacatgtacaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctg

SEQ ID NO: 654 - DNA, 4762 bp, Homo sapiens
ggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcacagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctggaaaaaaaaaaaaaaaaaaaaaaaaaaaaaaaaaaaaaaa

SEQ ID NO: 655 - DNA, 4621 bp, Homo sapiens
gccgggagaaccgaacccctggcggccgcgaccccggctcccgccccggccccggcccgacccgccatgacggggctggaggaccaggagttcgacttcgagttcctcttcgagtttaaccagcgcgacgagggcgccgccgcggccgccccagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcaggtgagtgcgcctccaagcagtagctgcccccctggtctcgaacactcgctctgccccagcagcccctctcctccactcccgcctgccacccaagagccgacctgcctgcagccctgcagcccagcgtgcccgcccgccacgggccgcccgcagcacctgccgtccacggtccgcagggacgagtctccgactgccgggccacggctgctgccagaggtgcatgaggacggtagtcctaatttggcccctattcctgtaacggtcaagcgagagcctgaagagttggaccagttgtacctggatgacgtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcacagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctggaaaaaaaaaaaaaaaaa

SEQ ID NO: 656 - DNA, 3671 bp, Homo sapiens
ggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcacagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctggaaaaaaaaaaaaaaaaaaaaaaaaaaaaaaaaaaaaaaaaaaaaaaa

SEQ ID NO: 657 - DNA, 4336 bp, Homo sapiens
gccgggagaaccgaacccctggcggccgcgaccccggctcccgccccggccccggcccgacccgccatgacggggctggaggaccaggagttcgacttcgagttcctcttcgagtttaaccagcgcgacgagggcgccgccgcggccgccccagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcacagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctggaaaaaaaaaaaaaaaaaaaaaaaaaaaaaaaaaaaaaaa

SEQ ID NO: 658 - DNA, 3140 bp, Homo sapiens
ggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacggtaacgccatctttctaaccgtaagccgtgaacatgagcgcgtggggtgctttttctaaagacgcagaaacgacgtcgccgtaaagcagcgtggcgtgttgcacatttaactgtgtgatgtcccgttagtgagaccgagccatcgatgccctgaaaaggaaaggaaaagggaagcttcggatgcattttccttgatccctgttgggggtggggggcgggggttgcatactcagatagtcacggttattttgcttcttgcgaatgtataacagccaaggggaaaacatggctcttctgctccaaaaaactgagggggtcctggtgtgcatttgcaccctaaagctgcttacggtgaaaaggcaaataggtatagctattttgcaggcacctttaggaataaactttgcttttaagcctgtagtcctgatgtggtctttaaggatggtgaatgagctttgtgctgggcggacgtccccgagacacttctccaggggtaacttcatctcctgggaccacgggcatccaggctggggcaccttctcctcaacctgcctgcccctcacccgccgtgggaatggctccttttcactcatac

SEQ ID NO: 659 - DNA, 3686 bp, Homo sapiens
ctgggttgtgtcgccgcggtaggcgctgcgctctgagcgcagcgcaggccccgtaccgaccgcccgcccgccctctgtccgcgatggaggtgccggccgcgggtcgcgttcctgccgagggcgccccgacggcggctgtggccgaggtgcgctgcccggggcccgcgccgctgcgcctgctggagtggagggtggcggcgggcgcggccgtgcgcatcggctcggtgctggccgtgttcgaggccgccgcctccgcgcagtccgccggggcctctcagtcccgtgtagcctccgggggctgcgtgcgccccgcgcggccggaacgcaggctgaggtcggagcgcgcgggcgtggtgcgggagctgtgcgcgcagccgggccaggtggtcgccccaggagcggttctggtgaggttggaaggatgcagccacccggttgtcatgaaaggcctgtgtgctgaatgtggccaagacctcacccagttgcagagtaagaacgggaagcagcaggtgccgctgtccacggcgaccgtgtccatggtgcacagcgtgccggagttgatggtgagctccgagcaagctgaacagctgggaagagaagaccagcagcgactgcaccgaaaccggaagctggtgctcatggtggacttggaccagacgttgattcacacaaccgagcagcactgtcagcagatgtcgaataaaggcatctttcacttccagctgggccggggtgagcccatgctgcacacgcgcctgcgtccacactgcaaggacttcctggagaagatcgccaagctgtacgagctgcacgtcttcaccttcggcagccggctgtacgcacacaccatcgcaggctttttagaccccgagaagaagcttttttctcaccgaatattatcaagggatgaatgtattgacccattttctaaaacgggaaaccttagaaatctctttccttgtggagactccatggtttgcattattgatgatcgaaaagatgtctggaagtttgcccccaatctgataactgtgaagaaatatgtatacttccagggcacgggtgatatgaatgcgccccctgggtcccgagaatctcagacgagaaagaaagtaaatcattctcgaggcactgaggtctcagagccatctccgcccgtgagagaccctgagggggtaacgcaggcccctggagtggagcccagcaatggcctggagaagcctgcacgggagctgaacggcagcgaggccgccaccccgcgggactcaccccgccccgggaagccagacgagagggacatctggccccctgcccaggcccccaccagcagccaagagctggcaggcgctcctgagccccagggatcctgtgcgcagggtggccgggtggcaccgggacagcggcctgcccagggtgccacgggcactgacctggactttgacttatccagcgacagcgagagcagcagtgagtccgagggcacgaagtcctcctcctccgcctctgatggcgaaagcgaggggaaaagaggccggcagaagccgaaggctgccccagagggagccggggcgctggcacagggcagttccctggagccggggcggcctgcagcaccgagtctccccggagaggccgagcctggcgcgcatgccccggacaaggagcctgagctgggtgggcaggaggagggcgagcgggatggcctctgcggcctgggcaacggctgtgccgacaggaaggaggcggagaccgagtcacagaacagcgagctgtcgggggtcactgcgggtgagtccctggaccagagcatggaggaggaggaggaggaggacacggatgaggatgaccacctcatctacctggaggagatcctggtccgtgtacacactgactactatgccaagtatgaccgctacctcaacaaggagatcgaggaggcgccggacatccgcaagatcgtgccggagctcaagagcaaggtgctggcagacgtggccataattttcagtgggctacacccgacaaacttcccgatagagaagacgcgggagcattaccacgccacggcgctgggagcgaagatcctcactcggctggtgctgagccccgacgcccctgacagggccacgcacctgatcgccgcgcgagctggcacagagaaggtgctgcaggcacaggagtgcggacacctgcacgtggtcaaccctgactggctgtggagctgcctggagcgctgggacaaggtggaggagcagctcttcccgctcagggacgatcacaccaaggcacagagggagaacagccctgcggcctttcccgaccgggagggtgtgccccccaccgccttgttccacccgatgccggttcttcccaaggcccagcctggccccgaggttcggatctacgactccaacacggggaagctcatcaggacgggcgcccgggggcccccagcaccctccagctccctacccatccgccaggagccctcttccttcagagcggttccgccaccccagccgcagatgtttggtgaagagctgcctgacgctcaggacggagagcagcctggcccttctagaagaaagcgacagcccagtatgtctgagacaatgccgctgtacactctttgtaaggaggatttagagagtatggacaaagaggtggacgacatccttggagaaggcagcgacgacagcgacagcgagaagaggaggcctgaggagcaggaggaggagccccagccccggaagccagggacccgcaggggagcggacgctcgggcacctgcgtccagcgagaggagcgcggcagggggccgggggcccagaggccacaagaggaagctgaatgaagaggacgccgccagcgagtccagcagggagtccagcaacgaggacgagggcagcagctccgaggccgacgagatggccaaggcgctggaggcggagctcaacgacctcatgtgagcgcgggcagcgggcagggactgaagcctgaccgacctccagcagcactcggacgtccccggaccagccctcagtctcggtccacgctgctttcttcccaaaggacatgtatatttgcagagctccacatacagaaacacattattttgcagaaataggtgtttttaagaagttttactacaggaatgtctacttttgtaagtgacaggtgttaaaggcccaggtgtgctgtgccaaagagctcagcagaggctcacgtggcccaggctggtgcgccccgctgtctcggtaaggggcgggttggtgtgtttccccttgtgtaccagagcacattccttaggggacggctttgggggtcccacgagacatggactaggagtttaagcaggacagtgtgcgtgcacgagctccgagcccagcacagacatgcctggaacccccgccgcctgctgctccctcctagggaacccatttccggggaacgccgtgactgtcgggcagcctggagcttcctgcagcctcctacgcagggtccacgccacgtggcctgggctgccatcctgccgtcctcccactggcatcctggcaagggggcgttgcttttcctgggcggccttttatgtcttggagacacctgatgtaaagtttctgtaaatctatttcatatctgacccaccaaacagatttctctttaataaaaatcctttttgtaagttc

SEQ ID NO: 660 - DNA, 3523 bp, Homo sapiens
ctgggttgtgtcgccgcggtaggcgctgcgctctgagcgcagcgcaggccccgtaccgaccgcccgcccgccctctgtccgcgatggaggtgccggccgcgggtcgcgttcctgccgagggcgccccgacggcggctgtggccgaggtgcgctgcccggggcccgcgccgctgcgcctgctggagtggagggtggcggcgggcgcggccgtgcgcatcggctcggtgctggccgtgttcgaggccgccgcctccgcgcagtccgccggggcctctcagtcccgtgtagcctccgggggctgcgtgcgccccgcgcggccggaacgcaggctgaggtcggagcgcgcgggcgtggtgcgggagctgtgcgcgcagccgggccaggtggtcgccccaggagcggttctggtgaggttggaaggatgcagccacccggttgtcatgaaaggcctgtgtgctgaatgtggccaagacctcacccagttgcagagtaagaacgggaagcagcaggtgccgctgtccacggcgaccgtgtccatggtgcacagcgtgccggagttgatggtgagctccgagcaagctgaacagctgggaagagaagaccagcagcgactgcaccgaaaccggaagctggtgctcatggtggacttggaccagacgttgattcacacaaccgagcagcactgtcagcagatgtcgaataaaggcatctttcacttccagctgggccggggtgagcccatgctgcacacgcgcctgcgtccacactgcaaggacttcctggagaagatcgccaagctgtacgagctgcacgtcttcaccttcggcagccggctgtacgcacacaccatcgcaggctttttagaccccgagaagaagcttttttctcaccgaatattatcaagggatgaatgtattgacccattttctaaaacgggaaaccttagaaatctctttccttgtggagactccatggtttgcattattgatgatcgaaaagatgtctggaagtttgcccccaatctgataactgtgaagaaatatgtatacttccagggcacgggtgatatgaatgcgccccctgggtcccgagaatctcagacgagaaagaaagtaaatcattctcgaggcactgaggtctcagagccatctccgcccgtgagagaccctgagggggtaacgcaggcccctggagtggagcccagcaatggcctggagaagcctgcacgggagctgaacggcagcgaggccgccaccccgcgggactcaccccgccccgggaagccagacgagagggacatctggccccctgcccaggcccccaccagcagccaagagctggcaggcgctcctgagccccagggatcctgtgcgcagggtggccgggtggcaccgggacagcggcctgcccagggtgccacgggcactgacctggactttgacttatccagcgacagcgagagcagcagtgagtccgagggcacgaagtcctcctcctccgcctctgatggcgaaagcgaggggaaaagaggccggcagaagccgaaggctgccccagagggagccggggcgctggcacagggcagttccctggagccggggcggcctgcagcaccgagtctccccggagaggccgagcctggcgcgcatgccccggacaaggagcctgagctgggtgggcaggaggagggcgagcgggatggcctctgcggcctgggcaacggctgtgccgacaggaaggaggcggagaccgagtcacagaacagcgagctgtcgggggtcactgcgggtgagtccctggaccagagcatggaggaggaggaggaggaggacacggatgaggatgaccacctcatctacctggaggagatcctggtccgtgtacacactgactactatgccaagtatgaccgctacctcaacaaggagatcgaggaggcgccggacatccgcaagatcgtgccggagctcaagagcaaggtgctggcagacgtggccataattttcagtgggctacacccgacaaacttcccgatagagaagacgcgggagcattaccacgccacggcgctgggagcgaagatcctcactcggctggtgctgagccccgacgcccctgacagggccacgcacctgatcgccgcgcgagctggcacagagaaggtgctgcaggcacaggagtgcggacacctgcacgtggtcaaccctgactggctgtggagctgcctggagcgctgggacaaggtggaggagcagctcttcccgctcagggacgatcacaccaaggcacagagggagaacagccctgcggcctttcccgaccgggagggtgtgccccccaccgccttgttccacccgatgccggttcttcccaaggcccagcctggccccgaggttcggatctacgactccaacacggggaagctcatcaggacgggcgcccgggggcccccagcaccctccagctccctacccatccgccaggagccctcttccttcagatggacgacatccttggagaaggcagcgacgacagcgacagcgagaagaggaggcctgaggagcaggaggaggagccccagccccggaagccagggacccgcaggggagcggacgctcgggcacctgcgtccagcgagaggagcgcggcagggggccgggggcccagaggccacaagaggaagctgaatgaagaggacgccgccagcgagtccagcagggagtccagcaacgaggacgagggcagcagctccgaggccgacgagatggccaaggcgctggaggcggagctcaacgacctcatgtgagcgcgggcagcgggcagggactgaagcctgaccgacctccagcagcactcggacgtccccggaccagccctcagtctcggtccacgctgctttcttcccaaaggacatgtatatttgcagagctccacatacagaaacacattattttgcagaaataggtgtttttaagaagttttactacaggaatgtctacttttgtaagtgacaggtgttaaaggcccaggtgtgctgtgccaaagagctcagcagaggctcacgtggcccaggctggtgcgccccgctgtctcggtaaggggcgggttggtgtgtttccccttgtgtaccagagcacattccttaggggacggctttgggggtcccacgagacatggactaggagtttaagcaggacagtgtgcgtgcacgagctccgagcccagcacagacatgcctggaacccccgccgcctgctgctccctcctagggaacccatttccggggaacgccgtgactgtcgggcagcctggagcttcctgcagcctcctacgcagggtccacgccacgtggcctgggctgccatcctgccgtcctcccactggcatcctggcaagggggcgttgcttttcctgggcggccttttatgtcttggagacacctgatgtaaagtttctgtaaatctatttcatatctgacccaccaaacagatttctctttaataaaaatcctttttgtaagttc

SEQ ID NO: 661 - DNA, 2490 bp, Homo sapiens
gggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctggtttggaaggcgctttgagtccccgctgctgtggcagagcgccatcatgatcctgaccatgctgctgatgctgaagctgtgcaccgaggtccgtgtggccaacgagctcaacgccaggcgccgctcctttacagctgcagatagcaaggatgaagaagtcaaggttgcccccaggcggtccttcctggacttcgacccccaccacttctggcagtggagcagcttctcggactacgtgcagtgcgtcctggccttcacgggcgtggcgggctacatcacctacctgtccattgactccgccctgtttgtggagaccctgggcttcctggctgtgctgaccgaagccatgctgggtgtgccccagctttaccgcaaccaccgccaccagtccacggagggcatgagcatcaagatggtgctcatgtggaccagtggtgacgccttcaagacggcctacttcctgctgaagggtgcccctctgcagttctccgtgtgcggcctgctgcaggtgctggtggacctggccatcctggggcaggcctacgccttcgcccgccacccccagaagccggcgccccacgccgtgcaccccactggcaccaaggccctctgacagtggggaggacgaggatgtgggaccgccagccgtgggcactggtgggccctgacctccccgcggggagggtgggtgccgtggcccctgcaggtgtggcagagatggggcatgggcattggggtctccatcagcctctgtggggtgtctcagggtgggcagtgggggtggggctgggacgctgtttgtgctcagcggggacagccagggttgatctggccccgagggttttggatgtttttaggatgacataaaaagcaagtgttttccccatttcctcttatgaaacaccgtctgagcccaaggtacacattgggcggcctgcaggaacctgctccaggtggacacacgggccagcagccgcgaaccttgaagctggggtgaccgcaggagaccctgtaaggcctgtgagcggagccctcgaccccgtgacaccctggccagacaccctgcttggactggggtggcctctgctacccaggggtctggcacgggggagggctggggctttctctgcctggtacacacggaaaggcggctgtgcggacgcagggtcaccgtgctccgggttttctgacagttggtgtttcctgggcctttggagtggctgcgaggcctgaacgccttgtggatccgctgtgtccagcccggctgagcatcgccagggctagctcatgctgctcttgtcagcctctggttctcctcgagtccttggggacgtggcagatgccagcgaccatcagacaacgtggaggccctcatgggcaatggctgagggggccgggctgaggctgtgcacatgcagtctgcacgccactcttgggctctgctggcggagatccccttccttctgggtgcagactgcacctccggatgcagttttgatgtccatcttccaggagagagacggtctcgggtccagggagtggagggggctgcccctgccgtgcaggtcctggccgatggcgccttaccctgctgccctgggcttttggcctgaagcaaattcctgagtggggggtactggggcctgccgcatcctgtcctgtccactgcccacccccgtgtgctggctccctcacttctggctgcagtgggagccgccagtctgacccttgtcaccgcacgctctgcccccaccccgttgcaagaggtcacaccatgtcagcagccttgcactgaccgcagccggcccccaggcctcagagttctggatgcttccgtgcggctccaacaggcatcgtcttcccttccgcaggtggaggggccgcttcccgcaggcatctgagctctgtgccggggccgtggccatgggaagatgttccacgctgcctcctcctcgagttttcctcggaaacactcttgaatgtctgagtgagggtcctgcttagctctttggcctgtgagatgctttgaaaatttttatttttttaagatgaagcaagatgtctgtagcggtaattgcctcacattaaactgtcgccgactgcaaaaaaaaaaaaaaaaaaaaaaaaaaaaaaaaaaaaaaaaaaaaaaaa

SEQ ID NO: 662 - DNA, 1415 bp, Homo sapiens
gtttgcgggtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggttaaaaattttgcagttatttatcttgtggatattacagaagtgcctgacttcaacaaaatgtatgagttatacgatccatgtactgtcatgtttttcttcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtgagcctgtgcgttttgcatactgggttggtttgctggggctgcggtgacagcatatgccgcgagctgggctttaacagagatgtgtgctctcacagctttgcaggcgggggtctgagatcagggtgtcgcgggtggggggtcactgctgaggccgtgaggggaatctgctcaggcctgtccctggcttctgggggctgctggtggtattttcagttccttggtgtgtggatacttcgccccatctctgccttcacctgtgtcctccctgtgtgggtgctggtgtccaaaatttccccttttcgtagtgacaccagctgtgttggattggggcccaccctgctccagcatggcctaatcttaactaattacatttgcaaggatcttatgtccacaaaagtcacagtctgaggtgctgggggttaggacttcaatatataaattttgcggttacacaattcaatccatgacagaatccaaaggtttactctggttataaaaacagtacaataaaatattgtttatagccttccctgtaaggaaaaaaaaaaaaaaaaaaaaaaaaaaaaaa

SEQ ID NO: 663 - DNA, 1419 bp, Homo sapiens
acacgccgcctgccaggcgtgagtcttcctcccgctctgcgccgtcgccccgtccacacgccgccaccctcgcgtcagttgtcgctccgcgcctgcgcccgttgtctccctgctcgctccgggtcccggcgccgcgccatgtgggctgcggcgggcgggctgtggcgctcccgcgcgggtctccgggccctgttccgtagccgcgatgctgcgctatttccaggctgcgagcggggacttcactgctctgctgtctcctgcaagaactggctcaagaaatttgcctcgaaaaccaaaaaaaaggtttggtatgaaagtccttccttgggttctcactcgacttacaaaccatccaagttggaattcctcatgaggagcacctcaaagaaaaccaggaaggaagaccatgcgcgcctgagggccctgaacggcctcctctataaggcactgacagacctgctgtgtacccctgaagtgagtcaggagctgtatgaccttaacgtggagctctccaaggtttccctgactccagacttctcagcctgccgagcgtactggaagacaacgctctctgctgagcagaacgcacacatggaggctgtcctgcagagaagtgccgcgcacatgaggcaccttttgatgtcccagcagaccctgaggaatgtgccaccgatagtgtttgttcaagacaagggaaatgcagctctagctgagcttgatcagttactggcagtcgcagactttggaccccgggatgaaagagacaactttgtacaaaatgatttcagggaccctgatgccccacaaccctgcggcaccacagagccgaccacaagctccagtctgtgtgggatcgatcatgaggcgctcaacaagcagattatggagtacaaaaggaggaaagataaagggctcgggggcctggtgtggcaggggcaggtggctgagctgacaacgcagatgcaaaagggaaggaagagggccaagccccgcctggagcaggacagctccctcaagagttacctgtcaggcgaggaggttgaagatgacctggacctggttggtgccccggagtacgaatgctatgccccggacacagaggagttggaggcagagagaggaggtggcagaacagaggatggccacagctgcggagcaagcagggagtagatggagaggctctgcccatcccacatttgcagggaaaagcattggcacgcaacgcagcatgtggcttcattgaggcagttgatggagttaaaccatctgctcttctgctacttcaacattttctagcttttccgtgtatctaaacacaatttgctacacaagtcactgtttttttttccatgcactgtgtgtaatttaaaaattaaatggccatcttatcacagattctcacaaaaaaaaaaaaaaaaa

SEQ ID NO: 664 - DNA, 3789 bp, Homo sapiens
atgaagaattcagccaagggcgagctcccggatgccaagagcccgtggtgggagatggacgaccaccgtggctgcagctcccaccccttccacgcggtgtggcagacgatggtgcagcctgggctcagagcagctcacatcacgtacacggcaccctcggctgttggggaaagaccgttaaagatgaggagacaaggccttcttccagggcgctgggccggcgtcctcaggcctgggggcccctctcgctggtcctgttgcatcctgtggacgatgaacacaaatgcagctgtggccgtgcctggcctgtgtgtgttgaacgcgttcctgccgtgcgggagccacctacccagcggagcctcagagtctgagttctcaatgaaaatttcaaaaatgtttcaaattcctgtggaaaatcttgacaacatcagaaaggtgcgaaaaaaggtgaaaggtattcttgtggatattgggcttgacagctgcaaggagttactgaaggaccttaaaggctttgatccaggagagaaatactttcataacacatcatggggtgatgtttctctctgggaaccttctggaaagaaagtgagatatcgaacaaagccatactgttgtggcctctgtaaatactctacaaaggtgcttacttcattcaagaatcatttacatcgttaccatgaagatgaaattgaccaagagctggtgatcccttgcccaaactgtgtatttgcatctcagcccaaagttgtgggaaggcacttcagaatgttccatgcacctgtccggaaagtccagaactacacagtgaatattttaggtgaaactaaatcatctaggagcgatgtgataagtttcacatgtctaaaatgtaacttttcaaacactttgtactacagcatgaagaagcatgtgctggtagcccattttcactacttaattaactcctactttggcctaagaactgaggaaatgggtgagcaaccgaaaactaacgatactgtttctatagagaagatcccaccacctgacaaatattactgtaaaaagtgcaacgccaatgccagcagccaggatgcgttaatgtatcacattttgacatcagacatacacagagatttggagaataagcttagatctgtgatttcagaacatattaagaggactggactcttgaagcaaacgcacattgctccaaaaccagcagcacatttggctgcaccagcaaatggcagtgctccaagcgctccagcgcagcctccttgcttccatcttgctttgccacagaacagtccaagcccagccgcaggacagccagtgactgtggcccagggtgcccctggaagcctcactcattccccccctgctgctggccaatcccacatgactctggtctccagccctctgcctgtgggccagaacagcctcaccctgcagcccccagcacctcagcccgtctttctttctcacggggttccacttcatcagtctgtgaatcctcctgtgttgcccttgagtcagccagtcggacctgtcaataagtctgttggaactagtgtcctccccataaatcagactgttcgccctggggttttacccctcacccagcctgtgggacccataaacagacctgttgggcctggtgttcttcctgtgagcccctctgtcacccctggggtcctgcaggctgtctcgccaggggtgctttctgtgagtcgggcggtcccgtctggagtccttcctgcaggccagatgactcctgcaggccagatgactcctgcaggggttatccctgggcaaacagcaacttctggggttcttcctactggccagatggtccagtcaggagttctccctgtgggccagacagctccgtcacgggttcttcccccaggccagacagccccattgagggttatctctgcaggccaggtggtcccgtctgggcttctttctcccaaccagacagtctcctcctcagctgttgtgcctgtaaaccagggtgtgaattctggtgttctgcagcttagtcagcctgttgtgtcgggagttcttcctgtgggccagccagtgaggcctggggtcttgcaactcaaccagactgtgggcaccaacattctgcctgtgaatcagccagtgagacctggtgcttcgcagaacaccaccttcctgacatcaggctctattctcagacagctcatccctacagggaaacaagtgaatgggattccaacctacacgctggcccccgtgtctgtcactctgccggttccccctggaggccttgcgactgtcgctccgccccagatgcccatccagctcctgccgtcaggtgcagctgcaccaatggccggttccatgcccggcatgccctctcctccagtgctggtgaatgctgctcagagcgtgtttgttcaggcctcctcctctgcagcagacacaaaccaggtgctcaaacaggccaagcagtggaagacctgccctgtctgcaacgagctctttccgtccaacgtctaccaggtccacatggaggtagcgcataagcacagcgagtccaagtctggtgagaaacttgagcctgaaaaactggcagcgtgtgcaccatttctaaagtggatgagagagaaaacggtgcgatgtctgtcttgtaagtgcttggtctctgaggaagagcttatacaccacttgctgatgcatggcttggggtgcttgttctgtccatgcaccttccatgatatcaaaggtctttcagagcacagcaggaataggcacctggggaagaagaagttgcctatggattatagcaacagaggttttcaattagatgtcgatgccaatggcaacctgctctttccccaccttgatttcatcaccatattgccaaaggagaagcttggggagcgggaagtctacttggcaatcctggctgggatacactccaagtcactggtgcctgtgtatgtgaaggtgaggcctcaggctgagggcacccccgggagcaccggcaagcgagtgtccacctgccccttttgctttggcccctttgtgacaactgaggcctatgagctgcatttgaaggagaggcaccacatcatgcccacagtccacacggtcctgaagtctcccgccttcaagtgcatccactgctgtggggtctacacgggaaatatgaccctggctgccatcgccgtccatttggtgcgctgcagaagtgctcccaaggacagcagctcagacctgcaggcccagccgggttttattcacaacagtgaactgcttttagtcagtggtgaagtgatgcatgattccagtttttctgttaagagaaagctgcctgacggccacttaggggccgaagaccagcggcatggggaggagcagcctcccatcctaaatgccgatgcagccccgggtccagaaaaggtgacgagtgttgtgccttttaaaagacaaaggaatgaaagcagaacagagggacctattgtcaaggacgaggctcttcagattttagcattagatcctaaaaaatatgaaggccgttcttatgaagaaaagaagcaatttcttaaagattatttccataagaaaccatatcctagtaaaaaggaaatagaactgttgtcctcactcttttgggtgtggaaaattgatgtggcttcattttttggaaaaagaaggtatatttgcatgaaagcaataaaaaatcacaagccttctgtacttttaggctttgatatgtctgaacttaaaaatgtgaaacatagattgaactttgaatatgaaccataa

SEQ ID NO: 665 - DNA, 1593 bp, Homo sapiens
cgcgtgggcgtgcctgtctgctccggcagcaccatgtcgctcttgttcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgatcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgcccccatggt

SEQ ID NO: 666 - DNA, 1376 bp, Homo sapiens
tccccactgctcagcacttaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgcagacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttgagcctgggcgacagagcgagactccatctcaaaaaaaaaaaaaaaaaaaaaaaccacataggctcagtcttttcagtatctgctttactggttcagtaaaagccaggaaacacaactttgtggtaatctgaatgttattgaactgtattttgttcactttattgtaaatactagtgaacagtgaataaatggttgtatattcctaataagaaaaaaaaaaaa

SEQ ID NO: 667 - DNA, 1733 bp, Homo sapiens
  misc_feature 19: n = A,T,C or G
ttcggcacaggcgggagancggcggggccgaagcgtgaactcgcccgctccggcttgcttcccccgcgccgcctccccgcgccgctcggaagccatgtccgaggagaagcccaaggagggtgtgaagacagagaatgaccacatcaacctgaaggtggccgggcaggacggctccgtggtgcagttcaagatcaagaggcacacgtcgctgagcaagctgatgaaggcctactgcgagaggcagggcttgtcaatgaggcagatcagattcaggttcgacgggcagccaatcaatgaaactgacactccagcacagctgagaatggaggacgaggacaccatcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggattgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggt

SEQ ID NO: 668 - DNA, 2737 bp, Homo sapiens
ctgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctga

SEQ ID NO: 669 - DNA, 2093 bp, Homo sapiens
cactgcgcttgcgcgggttgagggcggtggctcagtctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataggattatcgtagccaaggtgctcttctgggacaacgcgtacgagttcaacctcagcgctctgaaatctttagcagttaaggagtttttttcaaagcccaagtataaccacattttgaaaccagaagactgtctctctgaaccgtgcactatattgcagttggacatgagaaccgtgcaaatttctgatctagagaccctgaggggcgagctgcgcttcgacatcaggaaggcggggaccctgcacggcttcacggcctggtttagcgtccacttccagagcctgcaggaggggcagccgccgcaggtgctcagcacggggcccttccaccccaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctgtgttagtggtgcccttactgccgtcgctcatccactcgtgtgggacgtaggattgcacagggctgtgccagtggcgtgtagggaacactgccctggctcagcgtgcgagctaaggtggcgatgtatgcgatgggactctgcatgggatagtacagttgtgtagacgtcttccaaataaattatgtgttggtgccatcgcacatgctcaataaatattttaaatgagtgaaaaaaaaa

SEQ ID NO: 670 - DNA, 1287 bp, Homo sapiens
atggactctctgtggggcccaggagccgggagtcacccctttggggtccacaacacccggctgtccccagacttgtgtccagggaagatagtgttgagggccctcaaggagagcggggcagggatgcctgagcaggacaaggaccctagagtccaagagaatcctggtgatcagagaagggtcccggaggtcaccggggatgcaccgtctgcatttcggcccctgcgggacaatggaggcctctctccctttgtgcccgggcccgggcctctgcagacagacctccatgcccagaggtcagaaatcagatataaccagacatcccagacctcctggacgagctcctgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcaggtcacacccagtgtgaaaaggcagcagatatagcaccagggcagacactcaccctcaggaatgactcctccacatccgaggcctctaggcccagtacacacaagtttcccctgctgccatgcaggcgaggggagcctttgatgctgccacctcccttagagctggggtaccgggtcactgttgaagaccttgaccgggagaaggaggcggcattccagcgcatcaacagtgcactgcaagttgaggacaaggccatctcggactgcagaccctcacggccttcccacactttgtcctcacttgcaacaggggcttctggtctgcctgccgtttctaaagcacccagtatggatgcacagcaggagacacacaagtcccaagactgcctgggcctactggcccccttagcatctgctgcagaggtcccctctacagctcccatgtctgggaagaagcacagaccaccaggccccctgttctcctcctcagatccccttcctgccacctcttcccattcccaggactcagcccaggtcacctcgctgattcctgcccccttcccagctgcaagcatggatgcgggcatgagaagaacaaggcgtggcacttctgctcctgcagctgccgcagcagcccctcccccctccgcattgaaccccacgttggggtcactactggagtggatggaggcccttcacatttctgggcctcagccacagctgcagcaggtgcccagaggtcagaaccagagatcgcagacctcccggaccagctcgtgccccaaatga

SEQ ID NO: 671 - DNA, 3822 bp, Homo sapiens
ctgccagccccgcccagactccaggcaggttctcgttgctatggtgatcgccggtgcaagctggatgcttggacgcgccgctgccagtccaacgcagaccccgcccacgacgtcgacgattcgtgtagcccgcaggtcccgcgtggctctcgttgccatggtgatcgccgccgctggctcaggcggaccaggccgcgcggagccccagctttcacagccatcgctggactgtggaagaatgaggtcctccctgacacctttggggccccctgtgagccgcgaccgtgtcatcgccagcttccctaagtggtacacgccggaagcctgtttgcagctcagggagcacttccacgggcaggtcagcgctgcctgccaacgcaggaacacggggactgtcgggctcaaactctccaaggtggtggtggttggcgatctctacgtggggaagaccagcctcatccacaggttttgcaagaatgtttttgatcgagactacaaggccaccattggggtggactttgaaattgagcgctttgagattgctgggattccctatagcctccagatctgggacacagctgggcaggagaagttcaagtgcatcgcatctgcctactaccggggtgcccaggtgatcatcacggcctttgacctcactgacgtgcagaccctggagcataccaggcagtggttggaggatgctctgagggagaacgaggcaggctcctgcttcatcttcctcgtgggaaccaagaaggaccttctgtcaggggccgcatgtgagcaggccgaagcagacgctgtgcacctggccagggagatgcaggccgagtactggtcagtgtcggccaagactggcgagaacgtgaaggcattcttcagccgcgtagccgccctggcattcgagcagtcggtgctgcaggacctggagaggcagagcagtgcccggctccaggtcggcaatggagacctaatccaaatggaagggagtccgcccgagacccaggagagcaagaggccctccagcctgggctgctgctaactggggcctgcgtggaaggcctccgctccctgcacacacacggacaggaatttccgtgactgtggtgtggagactggagcccaagctctgcagcgtgtcgccctcaagctgtaggcccatgttccagtccctccacccacccaccgggctcagctccagggcacagtcacttgtccgttgcaggttgggcactagaaaaggcccccactggctgcctgggagccccacaccaccgggccagtgcaggcactgtggtgatcccataaaaggccagtccatttgcagggtcatcagacagtcacctttggcctcaagaggcctcagaactgcaaactcctgcgtcggtctatactactcggccatggcccacatcagcagtcaaccctgcactctttcccagcgatcttggatgtgtccccaggatccgtcacagtgttccaggcaacctggacttgtcaaagtcagcacctgaaggagaggccacctgccattccccctgggagttttctgttgtcagcaggacttatggttctgggtctcagagcttcaggcctcactgtccttctgccacggatgctcaaggttcctgggcagaccagcacctctggaggacaatggacaaaatgtctcttagacctgttctggctgaagggctatctctggcacctctgagatccctaggtcctgccctcctggtccgtgggccaggatgtgcagaacaaccactcaggcctttctggcccacctggacagtgcatttacctgtgtgctgcgggaggcagactgcacagctgtcctagggtaactcactctgcagcccttgaacatggcactgccctcctctggcactcatgctgggcctgtgcccactgctgcctctccatccctctctcattggcctatacatctcttaggacctttgtaatggtgtccatgcacctttagaggacttcagaggccctgccaagtctagcatgttcctgtctccaacaccgcctcctgcacatgcagagcagacagaaataccccacacattccccagcctctctgcccagtatgctcatccacagggttttctcactgctatgaaccagccccacagccccaggcccctgtcacctggctatgcccactcatcccacccgtctcgtgctgttgcttcccgtagatggcgagcaccttgcaggcagccttctgatcagtactgctctcctagggcctggcacactgcagctgccctgtaaatgttcagctcagcgattgccaaataccagttagggaagaacactggcatctttttctattcattcccccttcaacatattttttgtagttttttatataaatgacttttttttttttttgagatggagtttcacccttgttgcccaggctggagtgcaatggcgtaatctcggctcagtgcaacctctgcctcccaggttgaagcgattctcctgcctcagcctcccaagtagctgggattacaggcatgcaccaccatgcctggctaattttgtatttttagtagagatggggtttctccatgttggtcaggctgctctcggactcctgatctcaggtgacctgcccacctcggcctcccgaagtgctgggattacaagggtgagccaccatgcccggccataaatgattttattcatttttatgttttcttttgggcggcgggatggagtctctgtcacccaggctggcgtgcaatggcacgatcttggctcactgcaagcttccccttccgggttcatgccattctcctgcctcagcctcccgagtagctgggactacaggcacgtgtgaccatgccgggctaattttttatatttttagtagagagaggtttcaccgtgttagccaggatggtctcgatgatctgacctcgtgatctgcccgcctcggcctcccaaagtgctgggattacaggcctgagccaccgcgtccggcctccataaatgacttttaaaggggttgtatgtttagtgtgaacaaagacagtacaaagcatataaaatacaaggtgaaagccccccccccgccacattagctgcgcccctgaagtgtctccagcagaagagatggatgaatggaaggacacacagatggacagagagcaggaaagactgttagctctgctaacagtcaggactattccttctggactctgtgcctttgcctgcacagctagtgttgatggcttgtttgttgttttcaccagagtgagctccttctggacatactgcctggcagcctgccttcctagggagctggcgccaaggcctctccctgatggcacacaaggagcctccttcctgtagcagcgcccagttttcatgtggatggattgtagttcatttgaccctccccatccgcgggccatccggcttgtgtccagcttttagctcttgccaatggtgctgcagtggccattcttgtagttatagctttgcgtactcaggaaggcccttctcccgactgcggcccccagcctggtccactaaatgcagcctgtggtcgggcagacagcattggggtccattaggaagaccaggtttgctgggcataagcttcacaggacgggagaacctgcccatggtggactgtcgttctccacagctcccttcccttgccccttcgggcctccaggatatgtttgcgggggtgggtgtggtgtccagctgttaccagcttctgagctagagctgtactgcctcacgtacacccccacctctgtaaatggtccttgattaaatcgtcctcatatt

SEQ ID NO: 672 - DNA, 4739 bp, Homo sapiens
ggggagataggtaggagtagcgtggtaagggcgatgagtgtgggccgggcgggagtgcggcgagagccggctggctgagcttagcgtccgaggaggcggcggcggcggcggcggcagcggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcggggccatgggggccgcccggcgcccggggccgggcctggcgaggccgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgagctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagagtgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaatctgtactgcaccctggaggtggattcctttgggtattttgtgaataaagcaaagacgcgcgtctacagggacacagctgagccaaactggaacgaggaatttgagatagagctggagggctcccagaccctgaggatactgtgctatgaaaagtgttacaacaagacgaagatccccaaggaggacggcgagagcacggacagactcatggggaagggccaggtccagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggatgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcagacagatggcctggaaacctctggctaatcgggccatccgtagagcgggaaccttcctgaggtgtccttgggccacccccaagtgttgggccatctgccaagagacagcgacccaaagccgaaggacaggtggcctgggcagatctcgcccaggtctgggagccccaggctggcctcagactgtggttttttatgtggccacccgagggcgccccaagccagttcatctcagagtccaggcctgaccctgggagacagggtgaagggagtgatttttatgaacttaacttagagtctaaaagatttctactggatcacttgtcaagatgcgccctctctggggagaagggaacgtgaccggattccctcactgttgtatcttgaataaacgctgctgcttcatcctgtg

SEQ ID NO: 673 - DNA, 4714 bp, Homo sapiens
ggggggagggtggcggctcgatgggggagccgccccagggggcccccccgccctgtgcccacggcgcggcccctttaaggaggcccgcctggctccgctccatcgcgcatcgcggccgcctccccccggccctcccttcctgcggcgcagagtgcgggccgggcgggagtgcggcgagccggctggcttagcgtccgaggaggcggcggcggcggcggcggcagcggcggcggcggggctggtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcggggccatgggggccgcccggcgcccggggccgggcctggcgaggccgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccggaagggccatggccagcccggggcggacgccgagaagcccttctacgtgaacgtcgagtttcaccacgagcgcggcctggtgaaggtcaacgacaaagaggtgtcggaccgcatcagctcccttggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatcatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatgacgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctgaagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagtcctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcggcacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagagtgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaatctgtactgcaccctggaggtggattcctttgggtattttgtgaataaagcaaagacgcgcgtctacagggacacagctgagccaaactggaacgagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggatgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcagacagatggcctggaaacctctggctaatcgggccatccgtagagcgggaaccttcctgaggtgtccttgggccacccccaagtgttgggccatctgccaagagacagcgacccaaagccgaaggacaggtggcctgggcagatctgcccaggtctgggagccccaagctggcctcagactgtggttttttatgtggccacccgagggcgccccaagccagttcatctcggagtccaggcctgaccctgggagacagggtgaagggagtgatttttatgaacttaacttagagtctaaaagatttctactggatcacttgtcaagatgcgccctctctggggagaagggaacgtgaccggattccctcactgttgtatcttgaataaacgctgctgcttcaaaaaaaa

SEQ ID NO: 674 - DNA, 901 bp, Homo sapiens
ggccacatggactggggtgcaatgggacagctgctgccagcgagagggaccagggcaccactctctagggagcccacactgcaagtcaggccacaaggacctctgaccctgagggccgatgaggccagggacaggccaggggggccttgaggcccctggtgagccaggccccaacctcaggcagcgctggcccctgctgctgctgggtctggccgtggtaacccatggcctgctgcgcccaacagctgcatcgcagagcagggccctgggccctggagcccctggaggaagcagccggtccagcctgaggagccggtggggcaggttcctgctccagcgcggctcctggactggccccaggtgctggccccgggggtttcaatccaagcataactcagtgacgcatgtgtttggcagcgggacccagctcaccgttttaagtcagcccaaggccaccccctcggtcactctgttcccgccgtcctctgaggagctccaagccaacaaggctacactggtgtgtctcatgaatgacttttatccgggaatcttgacggtgacctggaaggcagatggtacccccatcacccagggcgtggagatgaccacgccctccaaacagagcaacaacaagtacgcggccagcagctacctgagcctgacgcccgagcagtggaggtcccgcagaagctacagctgccaggtcatgcacgaagggagcaccgtggagaagacggtggcccctgcagaatgttcataggttcccagccccgaccccacccaaaggggcctggagctgcaggatcccaggggaagggtctctctctgcatcccaagccatccagcccttctccctgtacccagtaaaccctaaataaataccctctttgtcaaccagaaa

SEQ ID NO: 675 - DNA, 785 bp, Homo sapiens
ggccacatggactggggtgcaatgggacagctgctgccagcgagagggaccagggcaccactctctagggagcccacactgcaagtcaggccacaaggacctctgaccctgagggccgatgaggccagggacaggccaggggggccttgaggcccctggtgagccaggccccaacctcaggcagcgctggcccctgctgctgctgggtctggccgtggtaacccatggcctgctgcgcccaacagctgcatcgcagagcagggccctgggccctggagcccctggaggaagcagccggtccagcctgaggagccggtggggcaggtcagcccaaggccaccccctcggtcactctgttcccgccgtcctctgaggagctccaagccaacaaggctacactggtgtgtctcatgaatgacttttatccgggaatcttgacggtgacctggaaggcagatggtacccccatcacccagggcgtggagatgaccacgccctccaaacagagcaacaacaagtacgcggccagcagctacctgagcctgacgcccgagcagtggaggtcccgcagaagctacagctgccaggtcatgcacgaagggagcaccgtggagaagacggtggcccctgcagaatgttcataggttcccagccccgaccccacccaaaggggcctggagctgcaggatcccaggggaagggtctctctctgcatcccaagccatccagcccttctccctgtacccagtaaaccctaaataaataccctctttgtcaaccagaaa

SEQ ID NO: 676 - DNA, 2260 bp, Homo sapiens
aagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctgcagggggatggggtggggtacaaccaccatgacaactgccgggagggccacgcaggtcgtggtcacctgccagcgactgtctcagactgggcagggaggctttggcatgacttaagaggaagggcagtcttgggacccgctatgcaggtcctggcaaacctggctgccctgtctcatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttct

SEQ ID NO: 677 - DNA, 1640 bp, Homo sapiens
gaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatggtaaaaaaacaaaacctaacactaaggatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcggggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttcttc

SEQ ID NO: 678 - DNA, 1004 bp, Homo sapiens; identical to SEQ ID NO: 423

SEQ ID NO: 679 - DNA, 1385 bp, Homo sapiens
gggaagtcctggcccttggcccaacctcctgctgtccccggtctgagggcccaagccccgcgtctccgccttgccgtccagcctgtccttggtgtggggtgcttggaagtgtgagcaccctctctggctctttgccggccccaagggtcgttgcggcggcccccgggcccagtcatcagccctcttttccggtgccggaactatcgtactggtgccctagtttcccagccggcaggcggagtgaggaggaagcggaggcgagaccgcgctcaacactggggaaaggaaggaggcgggccctgcgcgcagcattttgggaaagagtggaattctgggtgttaggcccgccattcgcttgactcacgccttcgccgtagcatctttcgcagcggaccgaagagaagaaaagtaggccagagccgaactctcttcctgccaagatgtctattggtgtgccgattaaagtactgcatgaggccgagggccacattgtgacatgtgagacgaacaccggtgaggtatatcgggggaagctcattgaagcagaggacaacatgaactgccagatgtccaacatcacagtcacatacagagatggccgagtggcacagctggagcaggtatacatccgtggcagcaaaatccgctttctgattttgcctgacatgctgaagaacgcacccatgttaaagagcatgaaaaataaaaaccaaggctcaggggctggccgaggaaaagctgctattctcaaggcccaagtggccgcaagaggaagaggacgtggaatgggacgtggaaacatctttcaaaagcgaagataattttctaagttgaacagaactttgtccttttttctttcaggttatctgagttcattggagtgggtgcttgtgcatatatgctaggtatcttttgccatctttctctttagatcaggggaaatgtttaagctaaataaatctggggggttttttgttctgttttgttttgttttctttgagaaaataaggactttgtgttcatttgaagtttgctttggctaaattttgacaccctgggggatgtcctgggagaatgccagtactttgaaatagcacagctattgatgagattttaagctgctgttcctggccagttgcaggttaagccccagaaaagttcaccttggagaagctccgagaacacacagattgtgtctcattcatcttcagacacaggcacatagtgtggcactttgttcagttaacatttgtggagctgtcatcagctcagctttaacaacacaggtgactctttcccttgataaagtcataggtaattcaggggctgggtgcggcggctcacgcatgtaatcccagcactttgggaggccaaggcgggcggat

SEQ ID NO: 680 - DNA, 4539 bp, Homo sapiens
acgtcatcgccgcgcgccggcttgccaggagctggagggggaggtaggcggggcggcgcgtgacctaaggcctctctgccgcgcgcgcaggtacggggcagaagtcgcaggtacccagctgctgcccacatttctggtccagagtcccgaaccccgagcactgggatgcctggctactccgagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatacttaggaaaccagaggaatggatttgacttttctgctaggattctctgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatggccacctctacctccacagaggcaaagtcagcctcgtggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctggtgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacacattacgaccgcattcagagcttgctgatggcaaacctgccgcaggtggccaccccgcaggatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctggagttctgagtaattaaatggcagcatttttttgtgacaaaggtaagggttaagacagtgtgtgtgtgtgtgtgtgtgtgtgtgtgtgtgtgtgtgcgcgcgcgcgcgcgcgcgtaacgtgggcgcatccctcttttccttccctgggttcagtgtggctgggtaaggaccgtctgtttgtagggctgccaggctgcagcctgctgctccagggagcaccagctgcagctgatccaatacaccaagcctgtgtctccctcttctatcacctctctccaggatctctgctgtctcttggatcccatctgcctagatggaagaggatcctatccgaagctaggataaatgttgtcttactcctctgctatgttctcccagaaaaaattgattacaagttctctgctgtggttgctgcagctccaggaagtccccgcaatgtctcacgttgtctttgaccagtggtccccagtaccaggccagcgaagacaactttataatgtcatttgtgttgtgaaaattcttccactgacccaaaatggaaccgtacaaagcctatccgtgtatatggaaaagtctcatgcacctggattaactcagaaaaagtaaagtcctgaaacttca

SEQ ID NO: 681 - DNA, 4557 bp, Homo sapiens
acgtcatcgccgcgcgccggcttgccaggagctggagggggaggtaggcggggcggcgcgtgacctaaggcctctctgccgcgcgcgcagagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatacttaggaaaccagaggaatggatttgacttttctgctaggattctctgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatggccacctctacctccacagaggcaaagtcagcctcgtggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagctttgagctacaccctgtccagctgttctgtacaaccctttccccttttctcccttcctgattgtgagcatgctgatgggtgggcatgatgcctcttgccctgcacaggtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctggtgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacacattacgaccgcattcagagcttgctgatggcaaacctgccgcaggtggccaccccgcaggatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctggagttctgagtaattaaatggcagcatttttttgtgacaaaggtaagggttaagacagtgtgtgtgtgtgtgtgtgtgtgtgtgtgtgtgtgtgtgcgcgcgcgcgcgcgcgcgtaacgtgggcgcatccctcttttccttccctgggttcagtgtggctgggtaaggaccgtctgtttgtagggctgccaggctgcagcctgctgctccagggagcaccagctgcagctgatccaatacaccaagcctgtgtctccctcttctatcacctctctccaggatctctgctgtctcttggatcccatctgcctagatggaagaggatcctatccgaagctaggataaatgttgtcttactcctctgctatgttctcccagaaaaaattgattacaagttctctgctgtggttgctgcagctccaggaagtccccgcaatgtctcacgttgtctttgaccagtggtccccagtaccaggccagcgaagacaactttataatgtcatttgtgttgtgaaaattcttccactgacccaaaatggaaccgtacaaagcctatccgtgtatatggaaaagtctcatgcacctggattaactcagaaaaagtaaagtcctgaaacttca

SEQ ID NO: 682 - DNA, 4069 bp, Homo sapiens
gcagatggtctaacggctggatagaggcatatttttagtttgaatttcctgcgcttacagaatggttttatctaatttgtagctactggggttctttattctctggggccacctgaaggctttcaaacacagtaataagccctcctcgggctgggaaacaggaagctgtgttttaaatgccgtgatcactggattaaaggaaacatggctccactctgttctcttgccaggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctggtgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacacattacgaccgcattcagagcttgctgatggcaaacctgccgcaggtggccaccccgcaggatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctggagttctgagtaattaaatggcagcatttttttgtgacaaaggtaagggttaagacagtgtgtgtgtgtgtgtgtgtgtgtgtgtgtgtgtgtgtgcgcgcgcgcgcgcgcgcgtaacgtgggcgcatccctcttttccttccctgggttcagtgtggctgggtaaggaccgtctgtttgtagggctgccaggctgcagcctgctgctccagggagcaccagctgcagctgatccaatacaccaagcctgtgtctccctcttctatcacctctctccaggatctctgctgtctcttggatcccatctgcctagatggaagaggatcctatccgaagctaggataaatgttgtcttactcctctgctatgttctcccagaaaaaattgattacaagttctctgctgtggttgctgcagctccaggaagtccccgcaatgtctcacgttgtctttgaccagtggtccccagtaccaggccagcgaagacaactttataatgtcatttgtgttgtgaaaattcttccactgacccaaaatggaaccgtacaaagcctatccgtgtatatggaaaagtctcatgcacctggattaactcagaaaaagtaaagtcctgaaacttca

SEQ ID NO: 683 - DNA, 4501 bp, Homo sapiens
gcagatggtctaacggctggatagaggcatatttttagtttgaatttcctgcgcttacagaatggttttatctaatttgtagctactggggttctttattctctggggccacctgaaggctttcaaacacagtaataagccctcctcgggctgggaaacaggaagctgtgttttaaatgccgtgatcactggattaaaggaaacatggctccactctgttctcttgccaggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggtaagtagtgaggcgcatggttgcctcttgagaacggcggtcttttatgctacctacccctgtacaagttatgcgaaggaaaccaagccatctgcatgtttatttcctctgctcataataggaaaatggatgttatggagcttcaagaatcgagttacccaccagaaccctaatggtaaagctatgattttaggcatgctgtcaaatccctgctttcagaccctccttaacttcatattgtgagactgctcggtcaagtgccaggagattgtgattgggagagggtaaggcaaacagcgactgccagaaagaccttttgcaggatgtggaggcgtcctcaggagagttatttcgatttattctgaagcctgagttggagcagatccctttcttagcttatatcttcttcttgtaaaagtgcttttcaacctttctctcccgaacatcttccttctccaaagctgggagtcatgttgcctgcagggactctttccttactgggcccaggagttcgaggtgcagtttggcaacctgtgtcctggctgaggaatgcactcacagcacccctttccgagcccacgtgtgggttggatgcatcacgccagtgcagctattgccccgctgccctctctggctcaggggaaagtcctgttcatattgctttgcaattccaggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctggtgctgtccctgctggctgaggagccgctgctgggagacagcgcagccatagaggaagtgaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctggagttctgagtaattaaatggcagcatttttttgtgacaaaggtaagggttaagacagtgtgtgtgtgtgtgtgtgtgtgtgtgtgtgtgtgtgtgcgcgcgcgcgcgcgcgcgtaacgtgggcgcatccctcttttccttccctgggttcagtgtggctgggtaaggaccgtctgtttgtagggctgccaggctgcagcctgctgctccagggagcaccagctgcagctgatccaatacaccaagcctgtgtctccctcttctatcacctctctccaggatctctgctgtctcttggatcccatctgcctagatggaagaggatcctatccgaagctaggataaatgttgtcttactcctctgctatgttctcccagaaaaaattgattacaagttctctgctgtggttgctgcagctccaggaagtccccgcaatgtctcacgttgtctttgaccagtggtccccagtaccaggccagcgaagacaactttataatgtcatttgtgttgtgaaaattcttccactgacccaaaatggaaccgtacaaagcctatccgtgtatatggaaaagtctcatgcacctggattaactcagaaaaagtaaagtcctgaaacttca

SEQ ID NO: 684 - DNA, 2950 bp, Homo sapiens
acgtcatcgccgcgcgccggcttgccaggagctggagggggaggtaggcggggcggcgcgtgacctaaggcctctctgccgcgcgcgcagagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatacttaggaaaccagaggaatggatttgacttttctgctaggattctctgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatggccacctctacctccacagaggcaaagtcagcctcgtggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggaaaatggatgttatggagcttcaagaatcgagttacccaccagaaccctaatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctggagttctgagtaattaaatggcagcatttttttgtgacaaaggtaagggttaagacagtgtgtgtgtgtgtgtgtgtgtgtgtgtgtgtgtgtgtgcgcgcgcgcgcgcgcgcgtaacgtgggcgcatccctcttttccttccctgggttcagtgtggctgggtaaggaccgtctgtttgtagggctgccaggctgcagcctgctgctccagggagcaccagctgcagctgatccaatacaccaagcctgtgtctccctcttctatcacctctctccaggatctctgctgtctcttggatcccatctgcctagatggaagaggatcctatccgaagctaggataaatgttgtcttactcctctgctatgttctcccagaaaaaattgattacaagttctctgctgtggttgctgcagctccaggaagtccccgcaatgtctcacgttgtctttgaccagtggtccccagtaccaggccagcgaagacaactttataatgtcatttgtgttgtgaaaattcttccactgacccaaaatggaaccgtacaaagcctatccgtgtatatggaaaagtctcatgcacctggattaactcagaaaaagtaaagtcctgaaacttca

SEQ ID NO: 685 - DNA, 4539 bp, Homo sapiens; identical to SEQ ID NO: 680

SEQ ID NO: 686 - DNA, 4557 bp, Homo sapiens; identical to SEQ ID NO: 681

SEQ ID NO: 687 - DNA, 4069 bp, Homo sapiens; identical to SEQ ID NO: 682

SEQ ID NO: 688 - DNA, 4501 bp, Homo sapiens; identical to SEQ ID NO: 683

SEQ ID NO: 689 - DNA, 2950 bp, Homo sapiens; identical to SEQ ID NO: 684

SEQ ID NO: 690 - DNA, 3565 bp, Homo sapiens
ccggccacggtgcttccgggttctggtgtaggagcggcgtcttctcgcgcggatggtgaagctgaatttggtacgctggaccctcggacagacagcaagagagagacaagcccgaggcctgacttctagcactcctgagtttgagccctatgagcagtggaacctagggaccaccaaggatccagatataattctttcctcagtaatagaaaaaagaatctgggatctaagaagatacctactcattttctaagtgactggccatgtcattgtcccacttataccgggatggggaaggccgcattgatgatgatgatgacgagcgggagaactttgagatcactgactgggatctccagaatgagttcaaccccaaccgacagcgccactggcagaccaaggaagaagccacctacggggtgtgggcagagcgagactcggatgatgagaggcccagctttggaggcaaacgggcccgtgactactctgcgccagtcaacttcatcagcgcagggctcaagaaaggggcagcggaggaggcagagttggaagattctgatgacgaagagaaacctgttaagcaggacgactttcctaaggattttggaccaaggaagctaaaaacgggtggcaattttaagcccagccagaaaggttttgcaggaggaaccaaatctttcatggacttcggcagctgggaaagacacacaaaaggaattggacagaagcttcttcagaagatgggctacgtccctggacggggcctcgggaagaatgcacaaggtatcattaacccaattgaagccaagcagagaaagggaaaaggtgctgtgggggcttatggatccgagcgcaccactcagtccatgcaagacttccctgtggttgactcagaggaagaagctgaagaggagtttcagaaggagctgagccagtggaggaaagacccaagtggaagcaagaagaagcccaaatactcttacaagaccgtggaagagttgaaggccaagggcaggattagcaagaagctcactgctccccagaaggaactttctcaagtcaaggtcatagacatgacaggccgggagcagaaggtctactacagctacagtcagatcagccacaagcacaacgttcccgatgatgggctgccgctacagtcccaacagctgccacagtctggcaaagaggccaaggcccccggcttcgcgctgcccgagctggagcacaacctgcagctgctcatcgacctcacggagcaggagatcatccagaatgaccggcagctacagtatgagcgggacatggtggtcaacctcttccacgagctggagaagatgaccgaggtcctggaccacgaggagcgggtcatctcgaacctcagcaaggtcctggagatggtggaggagtgcgagcggcggatgcagcccgactgcagcaaccccctcaccctggacgagtgtgcccgcatcttcgaaaccctgcaggacaagtactatgaggagtacaggatgtccgaccgtgtggaccttgctgtggccatcgtctatccactcatgaaggagtacttcaaggagtgggatcccctcaaagactgcacttatggcaccgagatcatctctaagtggaaaagcctcctagagaatgaccagctcttgtcccatggcggacaggacctctcagcagatgcctttcacaggttgatatgggaagtctggatgccttttgttcgaaatattgtcacccagtggcagccaaggaactgtgacccgatggtggactttttggatagttgggtgcacattattcctgtgtggatcttagataacatactggaccaactcatcttccccaagctgcaaaaggaggtggaaaactggaacccgctcacagacactgttcccatccactcttggatccacccatggctgccccttatgcaggcacggctggagccactctattcccccatccgtagtaagctgtccagcgccctgcagaagtggcaccccagcgactcctctgccaagctcatcctccagccctggaaggatgtcttcactcctggctcctgggaagcattcatggtcaaaaacatagtgcccaagctggggatgtgtcttggtgagctagtcattaacccccaccagcagcacatggatgcattctattgggtgattgactgggaagggatgatctctgtctctagcctggtgggacttcttgaaaagcacttcttccccaagtggcttcaggtgctgtgctcttggctcagtaacagcccaaattatgaggagatcaccaagtggtacctgggttggaagtcgatgttctcagaccaagtgctggcacatccatctgtcaaggacaaatttaatgaggcacttgatatcatgaaccgggcggtgtcctccaacgttggtgcctacatgcagccaggagcacgggagaacattgcctatctcacccacacggagcggaggaaggacttccagtacgaggccatgcaggagaggcgggaggctgagaacatggctcagaggggcattggcgtggccgctagctctgtgcccatgaactttaaggacctcattgagaccaaggctgaggagcacaacattgtcttcatgcccgtcattgggaagcgacacgaagggaagcagctctacacctttggccgcattgtgatctacatcgaccggggagtggtctttgtccagggcgagaagacgtgggtgcccacctcactgcagagcctgatcgacatggccaagtgaactgtggcaggtccagaaccagtcagagacttgcccctaagagggatgtactgtaaataaacagtatttttagatcaccttcaaaagggtaacttctttactcaggagctactccacatcaggccaggtcatgagggaaggatgtaaaatgggacaatgccacgtagggcaggaatctttataccaagtcctcatgtggggtatcgtcctcaaaacaggacagccaagttgatgttctttcctggcaaaggagttctctgtagttcctccatagcagccttccctttagtctctggtggcagcttctacctcagccaacactgagtacctcacaacgagttcagtcagtagcagaaggatcttctctcttgttcctgatgatttcaaggtcctcacagtcctgataatctggttcttcccgaaactcccaaatatctatggagagctgttctagcttttgcacagggaaccagtggacagaggtatcattaaatatgtccatgtattgtgaagtctgaggaaactcaagctcctccagtccttttaaaatctgagcagaaaaattcaagtataaaaacttcagatagtcacagtaatccccactcttctgggataaatttccactttacttgtcatccccactttactttttaaaaaaataacaaatagggtattttgatttaaatgcttttgcacaatgaattgggcgccccaaggacagtggatatcatggactgtgatactaagaataaaggaaataaggaaaaaactaagagatgcattaaaga

SEQ ID NO: 691 - DNA, 809 bp, Homo sapiens
acatgttccctgggcctatctcggaagcgggccacaatgaccctgcaatgcacaaagtcagcgggaccctggaagatggtggtgtgggatgaggacggcttccagggccggcggcacgagttcacggccgagtgccccagcgtgctggagcttggcttcgagactgtgcgatctttgaaagtgctgagtggagcgtgggtgggcttcgagcatgctggcttccaagggcagcagtacattctggaacgaggcgaatatccaagctgggatgcctggggcggcaacacggcctaccccgccgagaggctcacctccttccggcctgcggcctgtgctaaccaccgtgactcgaggctgaccatcttcgagcaagagaacttcctgggcaagaaaggagagctgagcgatgactatccttccctccaggccatgggatgggaaggcaatgaagtagggtccttccacgtccactctggggcctgggtttgctcccagtttccgggctaccgaggatttcagtatgtgctggaatgcgatcaccattccggtgactacaaacatttccgggagtggggctctcatgccccgaccttccaggtgcagagcatccgcaggatccagcagtgaacaggggtgcggcacggaggagcgcatgcgtgccttatctgcaatggaggcgctctggaggctgtggtgtgttctctccttctgcctccccctgtaacctgtgtgaacccagcacccatgtgaactggtccgtgcacagtcagcacaaaaaactcaaacgaataaaaaagagaaagtctggt

SEQ ID NO: 692 - DNA, 7568 bp, Homo sapiens
gcgcggaggcagggaaccggagccttggagcgacccaacccctcgtctcgctgccctcccgcgcctgcaacggtgcgcggagactccggcgaactcagacacccaacggcggagaacagaagcggcaggcggcggacgtggcccggaagctgcgcgccgaacgcagcgcacccgctgccgagcagaggagccgcgcctttccccgaccctcggctccagcccccggcgcctgccgcctcgcagcccctctgcgtcctcggctcgggggccggcaccggcgatgccgagcggacgctccagtcctccgacccgctgaagaagcagcagccgctcgcccggagcctacggggattgtgcgagcggatcgtgctcggtggaggctcgggctgcggggcgcggggactccggggggcggggggagggaccgctctgtcggtgcccggcgccagccgcggctttgaagggtctccctcccctgcccttagcagctctgccacggactccgggaggctgcgggcggcgtcctgagggctccccagcagacccaatcggacttgagaaggtgatcgctctgctctcccaacccccttccctccccattccccccacttaactttttgtctccgttcatccgcggcttcgtcccctccccggcagacccacccgcggctgtgacaaccgcccggggcatgggccccccaacacggctcctagaggccccgcggcctcgcaagatgtgagaggccctccccgggcagaatcggagcttcaggagaggagctaataccccgccccccgtccctcacatcaggcggggtggaggtgcgcgctgagcccccgcggtgctgagcgtcccggagcgcccaatcctgggctggaacgagtagctggccggaggcgcgccgcggagagccggctgtcatgccctattgatccccctctgccccccgccaagtatgtttgggctggaccaattcgagccccaggtcaacagcaggaacgctggccagggcgagaggaactttaacgagaccggactgagcatgaacacccactttaaggccccggctttccacactggggggccccctggccctgtggatcctgctatgagcgcgctggggcaacccccgatcttgggcatgaacatggagccctacggcttccacgcgcgcggccactcggagttgcacgcaggggggctgcaagcgcagcctgtgcacggcttctttggcggccagcagcctcaccacggccacccgggaagtcatcatccccaccagcatcacccccactttgggggcaacttcggtggcccggaccccggggcctcgtgcctgcacgggggtcgcctgctcggctacggcggcgcagccggaggcctgggcagccagccgcccttcgccgagggctatgagcacatggcggagagccaggggcctgagagcttcggcccgcagcgaccggggaacctcccggacttccacagttcaggtgcctccagccaccgcgtgccggccccatgcctgccgctggaccagagccctaaccgagccgcctccttccacggcctgccgtcctccagcggctccgattcccacagtctggagccacggagggtgacgaaccaaggagccgtcgactcgctggaatacaattaccgggcgaggcgccctcgggacattttgacatgttttcgccctctgactccgaagggcagctgcctcattatgcagcgggtcgccaggttcctggggggcggctttcccggggcgccctcggccatgcccagagctgcgggcatggtgggcttgtccaaaatgcacgcccagccaccgcagcagcagccccagcagcagcagcagccccagcagcagcagcagcatggtgtgttctttgagaggttcagtggggccagaaagatgcctgtgggtctggagccctcagtgggctccaggcacccgttaatgcagcctccccagcaggccccgccaccccctcagcagcagcccccgcagcagccgccacagcagcagccgccgccgccacccgggcttctagtccgacaaaattcgttgcccgcctgcgctccctcggccccagcagggcgaggcgggcacgcccagcggcggcctgcaggacggaggccccatgctgcccagccagcacgcgcaattcgagtatcccatccaccggctggagaaccggagcatgcacccttattccgagcctgttttcagcatgcagcatcctcctccgcagcaggcgcccaaccagcggctgcagcatttcgacgcgcccccctacatgaacgtggccaagaggcgcgcttcgactttccgggcagcgcgggagtggaccgctgcgcttcgtggaacggcagcatgcacaacggcgctctggataatcacctctccccttccgcctacccaggcctacccggcgagttcacaccgcctgtgcccgacagcttcccttcggggccgcccctgcagcatccggccccggaccaccagtccctgcaacagcagcagcagcagcagcagcagcagcaacagcagcagcagcagcagcaacagcaacagcaacagcagcagcagcagcagcgccaaaacgcggccctcatgattaagcagatggcgtcgcggaatcagcagcagcggctgcgccagcccaacctggctcagctaggccaccccggggacgtgggccagggcggcctggtgcatggcggcccggtgggcggcttggcccagccgaactttgagcgcgaaggcggcagcacgggcgccgggcgtctgggcaccttcgagcagcaggcgccgcacttggcgcaagagagcgcgtggttctcaggtccgcatccgccgcccggagacctgctgccccgtaggatgggcggctcgggtctgcccgctgactgtggcccgcacgaccccagcctggcgccccctcctccgcctggtggctcgggggtgctgttccggggccctctgcaggagccgatgaggatgcccggagaggccacgtgccgcgctgccttcaccggcctgcagttcgggggcagtctgggaggcctgggtcagctgcagtcgcccggggcgggcgtggggctccccagcgctgcttcggagcgccggcccccgccgccggactttgctacgtctgcgctcgggggccagccgggctttccgtttggtgcagccggccggcagtccacgccgcacagcggtccaggcgtgaactcgccccccagcgcgggagggggcggtggcagctctggtggcggcggtggcgggggtgcctacccgccgcagcctgatttccagcccagccagcgcacctcggccagtaaattgggcgcgctctcgctgggctccttcaacaagcccagctccaaggacaacctgttcggccagagctgcctggctgcgctctccaccgcttgccagaacatgatcgccagcctcggggcccccaacctcaacgtgaccttcaacaagaagaacccgccagagggcaagaggaaactgagccagaacgagaccgacggcgcggcagtggccggcaacccgggctcggattacttcccaggagggactgctcctgggggccccaggacccggaggccgtccgggaccagtagcagcggctccaaagcctcggggccgcccaaccctccagcccagggggacggcaccagcctctcccccaactacaccctggaatccacgtcggggaatgacggcaagccggtctccgggggcggcggccggggacggggtcgcagaaaaagggacagtggtcacgtgagccctggcaccttctttgacaagtactcggcggctccggacagcgggggcgcacctggggtgagcccagggcagcagcaagcgtcaggcgcagccgtcgggggaagctccgcaggcgagacgcgcggggcaccgacgccccacgaaaaggcgctcacgtcgccatcctgggggaagggggctgagttgctcctgggggatcagccggacctcattgggtccctggacggcggggccaagtcggacagtagttcgccaaacgtgggtgagttcgcctcggacgaggtgagcacgagctacgccaatgaggacgaggtgtcgtccagctctgacaacccccaggcactagttaaagcgagcaggagtcccctggtgaccggctcgcccaaactccctccccgtggggtaggcgccggggaacacggaccgaaggcgcccccgcccgccctcggcctgggcatcatgtctaactctacctcgacccctgacagctacggcggcggtgggggcccgggccatccgggcactccgggcctggagcaggtccgcaccccgacgagcagcagcggcgccccgccacccgacgagatccaccccctggagatccttcaggcgcagatccagctacagaggcagcagttcagcatctccgaggaccagcctctggggctgaagggtggcaagaagggtgagtgcgccgtcggggcctcaggggcgcagaatggcgacagcgagctgggcagctgctgctccgaggcggtcaagagcgccatgagcaccattgacctggactcgctgatggcagagcacagcgctgcctggtacatgcccgctgacaaggccctggtggacagcgcggacgacgacaagacgttggcgccctgggagaaggccaaaccccagaaccccaacagcaaagaagcccacgacctccctgcaaacaaggcctcagcatcccagcctggcagccacttgcagtgcctgtctgtccactgcacagacgacgtgggtgacgccaaggctcgagcctccgtgcccacctggcggtccctgcattctgacatctccaacagatttgggacattcgtggctgccctaacttgaatgacaagaaagatcccctcctctaccaggcccttcctctccccctgtctgtttccttccccctcaaccttaccccacccctctgttaatttgaaagggccactattgctgagtggatgagttttttttttttcctctaggttggtacctgcttagtggcatatggaccggaaagggttaatttaaagggggggaacctcaaaagtttttttaaaaaagaaacttgtctgccacagtatgttaccagtgttaacccttctgcagttagcaaacttttgcttaagcctttttcctctagatactccccatgtttcggtaatcttggcatacattttttagatgacctctttccttgttttgttttcatgctgctgtatgtccaagtattgttatttcataataagacaagagttgctttcttttttattctttttccttttcttaccccctccccttttattttctttttgctttgttcactgcttattaaaatggaaatcctggagaatagtagttctggaatattgccgggtgaaagtccaattgtcatcacaatgttatatattgacaccccagtgtcatcagtcaggcaggagccaaacaatgaatgcccctcttaggtattccgcctgggattttgttttgtctgttccctaagaaaatatattttcattcctgcaaacacagtgctcagccttcagttcccttccacttgagttctctcttctcctgctggaagccgcccctctctgcgatggacgtgaggacgtgtccagctctgctctgtgggaaggagttggaatgttcgacagcagtgttttctctccttttctgggcctcctcgcaaatgcccaggccctgcattttcacgctgtgctaagcagcctttggtctgcatgggggatggtgtgctcccagcctgcagtctttggagcaaggctgctgcccgtgccttgggtgctggagttggaggaggctgttctcagccctttcccttttctgaaagctgttcctggccgggcatcccagggaagaaggaggggactgcgtgtatctcctccacctctcccattccatccccagtccagcctgggcaaccccacccctgggagggatgaggcaccctcttgctcagcctgctcagccttctctgagcctttgcagggatctgcagactcctgagggctagaggacagagaaagagaatagaatgaaatgactttgattcctgcgccttttagttttgaactctggaattcctctgccccctccccaacatttttttggaatctcaccctgttgcaaaactagagccatgtcccaagcatctcacaaaggaataactgctctgagcagagatgagtggtggttggcaggggcaggcaactttgggtgctgctgatgcctgcaaaagccatttatggcttgtggtggggggcacatagattccccggtgggttagacaggaagtaactgatatcacttcacccaaatatataaccgtgatggttatctatttaatttcagtttttgttaacgagcgtgtcttactaaaacgctccactttgagctcccccaccccctccaggtcctcagagtttgcagatctgggctttctaaagcaagtgacctgaaggctctgggctcaccatacaacacccacgttgtttatttcaaagaacttttcagcgaagggagaggagctttcagaaaaacctcactctttcccctcccttctcccctctttccttctgccggtccttttggctggggtctgagtctgcggttctcgcctgggcagtcttgacgaggagcaaaccccgccttcagagggcagacaaagcaggtggcatgaattgatcagcgagaaaggtgtgagccgaggcagttcctgcgttctgctacaaaaggaatggaaagggaagggaatttccccccaccatgggctgtgggagagttgaccgtattctgggcaagactccatgacccctctgattctgcagtgtacagctgtttgagagcctcatcattttacttttgaaacaggaatgatttctccttaattgcttaaggccggggagcaaagtgtcttaacttctgtctttgactttcccagcgttgagtcatcaacactttgccaattagctcatggtcctggcaacctcagaaacccctgaagttttaaaaactttctcgctccccacgaccccagaatgaaacagctttaaaaatagccttaagcaaaaggatgttatttcattaaatttggtttaatggaaagaataaaagtaaatgaaaaacacaccctacacactagactccgaacactggtaatcagtactgcatagcaaactctttgggaaagaaaacgaaaatgttattgcacatgtaaaatatgaaaacttaactctgctgtgtgttaggcaatcctgtaatcttttttgactcttaaaagaaattcatttctgaaatgcttggttggaagactgtgacaatagctcatgaaattgagtgttatttttttctttcttttttaaaaaaatatgtaaagtgcagtcttctgtattcctgcatattgtatatacctgtatatgttttcctgagcagttaaataacaataaatatgacgttaatggtgaaaaaaaaaaaaaa

SEQ ID NO: 693 - DNA, 2547 bp, Homo sapiens
cttacaaggtacagtcctctgctcaggggggccaggagggtcttataggcatcattcaccagggtcgaatgcttctctgagaagtccttttcagtctgagacctctggctgaagaaatctgggtggacaagacgctgcagttgctggtacctgtgctggagcttcgctgtatcaactctgaaggaacggttgcagtccataaggctgaagtagtctcgagtggggtcaggtgcctgcagcgctcggcactgtgggcagaagaacctgtcctcccgcccggggccccatgggccgccgcagttccaacagcggggataattgcttcccgcctgcgacgcagcatcgcagcttagcggtctccttctgggaacccctgtcggccaaaacccccacacccggagcaaagccccggctctcccccgccacatctggccggcggcctatctagccgtggtcactcgtggggaaaagcaaagagagcgtctaaccagactaatgttgctgattggctggggagtcgagggggcgggatcacccgaggggaacccgggttctaagttccgctctcccttctaaactacaactcccaggaggcattgaggcggcgcctgacggccacatctgctgctcctcattggtccggcggcaggggagggggttttgattggctgagggtggagtttgtatctgcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 694 - DNA, 2460 bp, Homo sapiens
cttacaaggtacagtcctctgctcaggggggccaggagggtcttataggcatcattcaccagggtcgaatgcttctctgagaagtccttttcagtctgagacctctggctgaagaaatctgggtggacaagacgctgcagttgctggtacctgtgctggagcttcgctgtatcaactctgaaggaacggttgcagtccataaggctgaagtagtctcgagtggggtcaggtgcctgcagcgctcggcactgtgggcagaagaacctgtcctcccgcccggggccccatgggccgccgcagttccaacagcggggataattgcttcccgcctgcgacgcagcatcgcagcttagcggtctccttctgggaacccctgtcggccaaaacccccacacccggagcaaagccccggctctcccccgccacatctggccggcggcctatctagccgtggtcactcgtggggaaaagcaaagagagcgtctaaccagactaatgttgctgattggctggggagtcgagggggcgggatcacccgaggggaacccgggttctaagttccgctctcccttctaaactacaactcccaggaggcattgaggcggcgcctgacggccacatctgctgctcctcattggtccggcggcaggggagggggttttgattggctgagggtggagtttgtatctgcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 695 - DNA, 2799 bp, Homo sapiens
ccggaagtgcgggcgctcagggagctgtcaccgtggtcggcggcggcggcggcggcggcggcacagagccggtggtggagccgccgaggagggtcacgcagcacaatgccagctctgcccctggaccaactccagatcacccacaaggacccgaagacaggaaagctgaggacttcaccagcgctgcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtgatctttgacgagactctacagaagtgcctggactcctacctgcgctatgtcccccgcaaattcgacgagggggtggcctcagcccctgaggttgttgacatgcagaagcgcctccatcgaagtgtttttctcaccttcctccgcatgtccactcacaaggaatccaaagatcacttcatttccccttctgcgtttggagaaatcctctacaataacttcctctttgacattccaaagatcctggacctctgcgtgctctttggaaaaggcaactcaccactgctccagaagatgataggaaacatctttacacagcagccaagttactacagtgacctggatgaaaccctgcctaccatccttcaggtcttcagcaatatcctccagcactgtggtttgcaaggggacggggccaataccacaccccagaagcttgaggagaggggccgattgacccccagtgacatgcctctcctggaattaaaggacattgttctctacctttgtgatacctgcaccacactttgggcctttctggatatcttccctttggcttgccagaccttccagaagcacgacttttgttacagactagcttccttctacgaagcagcaattcccgaaatggagtctgcaattaagaagaggaggcttgaagatagcaagcttcttggtgacctgtggcagaggctctcccattccaggaagaagctaatggagattttccacatcatcctgaaccagatctgcctccttcccatcctagaaagcagctgtgacaacattcagggcttcatcgaagagttccttcagatcttcagctccttgctgcaggagaagaggttcctccgggactatgatgcactcttccccgtggccgaagacatcagcttgctgcagcaggcctcatcagtcttggacgagacgcggactgcctacatcctccaggcagtcgagagtgcatgggaaggggtggacagacggaaagccacagatgctaaagacccatcggtgattgaggagcctaatggggagcctaacggggtcacggtgacagcagaggcagtcagtcaagcatcatcacatccggagaactcggaggaagaggagtgcatgggagcagccgcggctgtgggccctgccatgtgtggggtggaactggactctctcatctcccaagtgaaggacctgctgccagaccttggtgagggcttcatcctggcctgcctggagtactaccactacgacccagagcaggtgatcaacaatatcctggaggagcggctggcccccaccctcagccagctggaccgcaacctagacagagaaatgaaaccagaccctacacccctgctgacgtctcgccacaacgtcttccagaatgacgagtttgatgtgttcagcagggactcagtagacctgagccgggtgcacaagggcaagagcaccaggaaggaggaaaacacgcggagtttgctgaacgacaagcgtgcagtggcggcacagcggcagcgctacgagcagtacagcgtggtggtggaggaggtgccactgcagccaggcgagagcctgccctaccacagtgtctactacgaggatgagtacgatgacacatacgatggcaaccaggtgggcgccaatgatgcagactctgatgacgagctcatcagccgcaggccattcaccatccctcaggtgctgagaaccaaagtgcctagagaagggcaggaggaggatgacgacgatgaggaagacgatgctgacgaggaggctcccaagcccgaccattttgttcaggaccctgcagtgctgagagagaaggcagaagccaggcgcatggcctttctcgccaagaaagggtaccggcatgacagctcaacagcagtggccggcagcccccgaggccatgggcagagccgcgagacaacccaggaacgcaggaagaaggaagccaacaaggcgacaagagccaaccacaaccggagaaccatggccgaccgcaagaggagcaaaggcatgatcccatcctgagacctggtgcagggccagtggggaggcagcggcaccagactcaccaggccgtgctcccatcgcctggggcctcctcactaggggccccaagttcaactcaacccctcaacagcctcagctttgcagcccctgagaaggccgcctctcatctaccagccagccatgagcgccttcctgcagaacacacagtgccttatgccacagccgaagaatccgtggggccggcaagcaggcaccttcccccagctgcgctagcgggaaagagatggggatggagtcccaaggcaagcgccccaaacctcgggccacaagacaccacttcccctttaccctggacagcaggaaacctgtatattcaaaaacacaaaaagtcctgctaataaaatttttgaccctttcaaaaaaaaaaaaaaaaaaaaa

SEQ ID NO: 696 - DNA, 2935 bp, Homo sapiens
ccgcaactcgctcggccgccgccatcttgcgagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagcccacagaagaagaagcatcttcaaaggaggattctgcaccttctaagccagttgtggggattatttaccctcctccagaggtcagaaatattgttgacaagactgccagctttgtggccagaaacgggcctgaatttgaagctaggatccgacagaacgagatcaacaaccccaagttcaactttctgaaccccaatgacccttaccatgcctactaccgccacaaggtcagcgagttcaaggaagggaaggctcaggagccgtccgccgccatccccaaggtcatgcagcagcagcagcagaccacccagcagcagctgccccagaaggtccaagcccaagtaatccaagagaccatcgtgcccaaagagcctcctcctgagtttgagttcattgctgatcctccctctatctcagccttcgacttggatgtggtgaagctgacggctcagtttgtggccaggaatgggcgccagtttctgacccagctgatgcagaaagagcagcgcaactaccagtttgactttctccgcccacagcacagcctcttcaactacttcacgaagctagtggaacagtacaccaagatcttgattccacccaaaggtttattttcaaagctcaagaaagaggctgaaaacccccgagaagttttggatcaggtgtgttaccgagtggaatgggccaaattccaggaacgtgagaggaagaaggaagaagaggagaaggagaaggagcgggtggcctatgctcagatcgactggcatgattttgtggtggtggaaacagtggacttccaacccaatgagcaagggaacttccctccccccaccacgccagaggagctgggggcccgaatcctcattcaggagcgctatgaaaagtttggggagagtgaggaagttgagatggaggtcgagtctgatgaggaggatgacaaacaggagaaggcggaggagcctccttcccagctggaccaggacacccaagtacaagatatggatgagggttcagatgatgaagaagaagggcagaaagtgcccccacccccagagacacccatgcctccacctctgcccccaactccagaccaagtcattgtccgcaaggattatgatcccaaagcctccaagcccttgcctccagcccctgctccagatgagtatcttgtgtcccccattactggggagaagatccccgccagcaaaatgcaggaacacatgcgcattggacttcttgaccctcgctggctggagcagcgggatcgctccatccgtgagaagcagagcgatgatgaggtgtacgcaccaggtctggatattgagagcagcttgaagcagttggctgagcggcgtactgacatcttcggtgtagaggaaacagccattggtaagaagatcggtgaggaggagatccagaagccagaggaaaaggtgacctgggatggccactcaggcagcatggcccggacccagcaggctgcccaggccaacatcaccctccaggagcagattgaggccattcacaaggccaaaggcctggtgccagaggatgacactaaagagaagattggccccagcaagcccaatgaaatccctcaacagccaccgccaccatcttcagccaccaacatccccagctcggctccacccatcacttcagtgccccgaccacccacaatgccacctccagttcgtactacagttgtctccgcagtacccgtcatgccccggcccccaatggcatctgtggtccggctgcccccaggctcagtgatcgcccccatgccgcccatcatccacgcgcccagaatcaacgtggtgcccatgcctccctcggcccctcctattatggccccccgcccaccccccatgattgtgccaacagcctttgtgcctgctccacctgtggcacctgtcccagctccagccccaatgccccctgtgcatcccccacctcccatggaagatgagcccacctccaaaaaactgaagacagaggacagcctcatgccagaggaggagttcctgcgcagaaacaagggtccagtgtccatcaaagtccaggtgcccaacatgcaggataagacggaatggaaactgaatgggcaggtgctggtcttcaccctcccactcacggaccaggtctctgtcattaaggtgaagattcatgaagccacaggcatgcctgcagggaaacagaagctacagtatgagggtatcttcatcaaagattccaactcactggcttactacaacatggccaatggcgcagtcatccacctggccctcaaggagagaggcgggaggaagaagtagacaagaggaacctgctgtcaagtccctgccattttgcctctcctgtctcccaccccctgccccagacccaggagcccccctgaggctttgccttgcctgcatatttgtttcgctcttactcagtttgggaattcaaattgtcctgcagaggttcattcccctgaccctttccccacattggtaagagtagctgggttttctaagccactctctggaatctctttgtgttagggtctcgatttgaggacattcatttcttcagcagcccattagcaactgagagcccagggatgtcctacaggatagtttcatagtgacaggtggcacttggctaatagaatatggctgatattgtcattaatcattttgtaccttgacatgggttgtctaataaaactcggacccttcttgtgaaaaaaaaaaaaaaaaaa

SEQ ID NO: 697 - DNA, 2818 bp, Homo sapiens
ccctactccgcctctcgggatcctttaagaggcggggcttggctgccagctccgcggcccgggcaaaaggctgggactttactccgggtggcggcgaggacgagtctgtgctccatcagctgccgcacccgccgcctcccgcccccaaaccccatccccgcggttgagccacgatgagcggcagagtcggcgatctgagccccaggcagaaggaggcattggccaagtttcgggagaatgtccaggatgtgctgccggccctgccgaatccagatgactattttctcctgcgttggctccgagccagaagcttcgacctgcagaagtcggaggccatgctccggaagcatgtggagttccgaaagcaaaaggacattgacaacatcattagctggcagcctccagaggtgatccaacagtatctgtcagggggtatgtgtggctatgacctggatggctgcccagtctggtacgacataattggacctctggatgccaagggtctgctgttctcagcctccaaacaggacctgctgaggaccaagatgcgggagtgtgagctgcttctgcaagagtgtgcccaccagaccacaaagttggggaggaaggtggagaccatcaccataatttatgactgcgaggggcttggcctcaagcatctctggaagcctgctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggagcaaattggaaggaggttttactgaaacatatcagccctgaccaggtgcctgtggagtatgggggcaccatgactgaccctgatggaaaccccaagtgcaaatccaagatcaactacgggggtgacatccccaggaagtattatgtgcgagaccaggtgaaacagcagtatgaacacagcgtgcagatttcccgtggctcctcccaccaagtggagtatgagatcctcttccctggctgtgtcctcaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctatgtcctgcggtttgacaacacctacagcttcattcatgccaagaaggtcaatttcactgtggaggtcctgcttccagacaaagcctcagaagagaagatgaaacagctgggggcaggcaccccgaaataacaccttctcctatagcaggcctggccccctcagtgtctccctgtcaatttctaccccttgtagcagtcattttcgcacaaccctgaagcccaaagaaactgggctggaggacagacctcaggagctttcatttcagttaggcagaggaagagcgactgcagtgggtctccgtgtctatcaaatacctaaggagtccccaggagctggctggccatcgtgataggatctgtctgtcctgtaaactgtgccaacttcacctgtccagggacagcgaagctgggggtggcggggggcatgtaccacagggtggcagcagggaaaaaaattagaaaagggtgaaagattgggacttaacacttcagggaagtcagctgccggggagaaacttgctcctaaatgaacacataagtttagatcgcaatgaggagtagcagggtagctggttgctagagttacggtggggatcagaaactcttccaaacattttagcactgaggctggggtagcttttggcttttcccaggtctcaggaggtggcctgagtcagcacacatcttcccactcggtagacaggctggcctctccctcactttgagactttggcaactcctgggccacacggcctgcctctttgattactaatgattgtcagtgactcagagcttcctgggacttcgggtacccacccgctgttctccatgcaaacaaagcgccagggaaatgacccacagggatcgcagctgcagggagggccagggaggttgggggtgggagtgaatgctaaaagcagatcgtccagtgcccttttcagtgctaccggcctctcaccaagcagtcctccatgtgagcaaccccgagacaaaaatgctaagtgggatcaagagagcagcactcggagagggtgtttgccagtctgagtgtcccgcggtgcccgccaacccgcttcctgactgacctgagcaaggtcttactaagcagtcccatctctgtgggaggcatgcaacgcgtgcagggagttcaggtgccggtcggcgtagccaggcctggaggccccccaggcaggaggccgcccaaaggcggggccggcgtctcgcagactaggggctgggggcggccacagacggcctcgaaaccacagcccttaccccaatcccacgagccccgccaacgaaccacaggtgctgggctttagagaacatgggaaggcggccccagacctggcgggaacgcctttccctcagagccaggccccggccccgtctgggaagctcatcttgcgaagctgagggagctcagggcaaaggccaggctagcgcggaccggaaggggccgaggctgcacgggcctctgccagaacgctcaggacatcccggcctgggtttacaacgctgttaggaaaattaaccaatgaataaagcaacgttcagtgcgca

SEQ ID NO: 698 - DNA, 3812 bp, Homo sapiens
gggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtttctcctctgcctcctacttaaaggtccatgttaaaacccaccacggtgttccccttccccaggtctccaggcaccaggagcccatcctgaatgggggagcagcgttccactgcgccaggacctatggcaacaaagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactcta

SEQ ID NO: 699 - DNA, 3674 bp, Homo sapiens
gggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactcta

SEQ ID NO: 700 - DNA, 3021 bp, Homo sapiens
gggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcaggtgtgggttgggagcagcagcggcctgccgcccctggaacctcttcctagcgacctgccatcatgggactttgcccagcctgctttgtggaggtcgtcccattcggttcctgacaccgccttttccctttctctaaaaaaatcattcccagcccttgaaaacctgggcccagcacactccagcaacactctcttctgcccagccccgccgggatatctgaggcagggctggaccaccccagagggcagcagggcctttacccagtggcctgttggctagcctgggcctccctggagagggttgacagtggaagggaacaggaggggcatttggcctgagacccctgcttttgggagaggctagcagggtggttcctgcccagcatgcccagctcctccctgggtgactcggagtctttcccatgtcagagcccccaaatgggggtagcaaggagcacctttctggaaccccctatagcatccaagtttctttctgggctctcttgccttttcccccctttcacagatggcacccctgggcatctgtccttgcctaggtgattttggaggttggtgccttcctgggaactagccaccagcttatctgcttcccttcccctggcatcacttcccataggcctggggtttctagactggggcctggccacccctttccccactccacgagtgagtcggcctccagagaagactggcacaattccaactagagtcaacccatgctgccctctgcccttcccactcagatctagatcctgctttcatttctggctagtgaagtagacttttgtgtttttgaggtttattagcaggtctgctcaggaaccaaactaatgagtagctttatattgggccaccccaatatatggctttgggggctgaaaaagcagatgtagaccccctccctcggatccttattggtgtgccctttagcactccgcagactctgcggggtgaacaggagtgatgataaaatttttcattctaaaaaaaaaaaaaaaaaaaaaa

SEQ ID NO: 701 - DNA, 3747 bp, Homo sapiens
gggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtctccaggcaccaggagcccatcctgaatgggggagcagcgttccactgcgccaggacctatggcaacaaagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactcta

SEQ ID NO: 702 - DNA, 4160 bp, Homo sapiens
agcaagctgagctcagagcgaagctggcgagccaaggagataaagaaccctcggtggggatgcccagagggtgcatgctccacgcccctcgaaaccgattctcattgctgctgctgcaaagcaacccgaagtgcgccacctacccgactgaggctgcgcaagccccggggtctgggcggggtggtcctcgtgcgcgccgcgtcgccgtggagacgagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagatgcgtggccagaaagttcttatatttatggattcgaatgacttttggaagagtatttccctctaaagccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatatacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctctttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcag

SEQ ID NO: 703 - DNA, 4160 bp, Homo sapiens; identical to SEQ ID NO: 702

SEQ ID NO: 704 - DNA, 2693 bp, Homo sapiens
ggaagctggagccacctgcggctctgagagggacagacggtgctcagcctgtgtcctggggcaaagctggattcattttcctccctggcgatcttctggggcccacagctggtgatatggaggcactgacaccctggtctcggcgcttgttttagaagaggcagaacagtgataaagacaaggatctaaatgggcaaggacgccctgccctcactgggctcactggcagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaaaaaaaaaaaaaaaa

SEQ ID NO: 705 - DNA, 4160 bp, Homo sapiens; identical to SEQ ID NO: 702

SEQ ID NO: 706 - DNA, 3789 bp, Homo sapiens; identical to SEQ ID NO: 664

SEQ ID NO: 707 - DNA, 1775 bp, Homo sapiens
agcggccggggcgagccagcgagagggcgcgagcggcggcgctgcctgcagcctgcagcctgcagcctccggccggccggcgagccagtgcgcgtgcgcggcggcggcctccgcagcgaccggggagcggactgaccggcgggagggctagcgagccagcggtgtgaggcgcgaggcgaggccgagccgcgagcgacatgggggaccgggagcagctgctgcagcgggcgcggctggccgagcaggcggagcgctacgacgacatggcctccgctatgaaggcggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatattaaaaaaaaaaaaaaaaaaaaaaaaaaa

SEQ ID NO: 708 - DNA, 5487 bp, Homo sapiens
tctgtcgacttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctgcaaacagcagatggcttcccatatcccagagagtaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgcgccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccacacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgtttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcac

SEQ ID NO: 709 - DNA, 2310 bp, Homo sapiens
ggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctgggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgct

SEQ ID NO: 710 - DNA, 3108 bp, Homo sapiens
ggagcccatgatttcctggaagagccctagagctttgctttttctctcctgcagcacttaaccgaaaccagttttgcaatcaattcctgttcaaaggccaccctactcttcctatccgtctttctccagcccagacactcacagccccctgccagaccaggggacctcggagaggcaaggacagaggttcaggatcttcctctccctcgggacccaaggccacaaaggagagctccgtggagagaagaaaatcatttgactcctggggacacagatttgctgccacagaggctgatggacaaccaggcggagagagaaagtgaggctggtgttggtttgcaaagggatgaggatgacgctcctctgtgtgaagacgtggagctacaagacggagatctgtcccccgaagaaaaaatatttttgagagaatttcccagattgaaagaagatctgaaagggaacattgacaagctccgtgccctcgcagacgatattgacaaaacccacaagaaattcaccaaggctaacatggtggccacctctactgctgtcatctctggagtgatgagcctcctgggtttagcccttgccccagcaacaggaggaggaagcctgctgctctccaccgctggtcaaggtttggcaacagcagctggggtcaccagcatcgtgagtggtacgttggaacgctccaaaaataaagaagcccaagcacgggcggaagacatactgcccacctacgaccaagaggacagggaggatgaggaagagaaggcagactatgtcacagctgctggaaagattatctataatcttagaaacaccttgaagtatgccaagaaaaacgtccgtgcattttggaaactcagagccaacccacgcttggccaatgctaccaagcgtcttctgaccactggccaagtctcctcccggagccgcgtgcaggtgcaaaaggcctttgcgggaacaacactggcgatgaccaaaaatgctcgcgtgctgggaggtgtgatgtccgccttctcccttggctatgacttggccactctctcaaaggaatggaagcacctgaaggaaggagcaaggacaaagtttgcggaagagttgagagccaaggccttggagctggagaggaaactcacagaactcacccagctctacaagagcttgcagcagaaagtgaggtcaagggccagaggggtggggaaggatttaactgggacctgcgaaaccgaggcttactggaaggagttaagggagcatgtgtggatgtggctgtggctgtgtgtgtgtctgtgtgtctgtgtgtatgtacagtttacatgaatgttcctcaggacatggcatacaatggccttggaggtccaaataatatcaagtacatcttggagatgagggtgcctgtcctggacagacctcggcatgccttctgtttctccttcaatgctccttaaggcctatgtgctgggaaaagggtcttccctgtttgtttgtttgtttgtttgtttgtttgttttgagactccagtctgggtgtcagaatgagaccccatctcaaaaaaaaaaaaaaaaaaaaaaaagaagaagaatacagtcatgtatctcttggtgacagggacgcattctgataaatgtgtcattaggcaattgcattgtagtgtgattatcacagattgtacttatacaaaacttagatggcatagcctactgcatacctaggctatatgggagagcctattgctcccaggctacgcacctgtacagcatgtgactactgaatactataggcaattgcagcacaatgggaaatatttgtgtatctaaacatatgtaaacagagaaaaaggaaagtaaaaatatggcataaaagataagaattggctctcctgtacagggcacttactacgaatggagcttgcagggctgagagttgctccagatgagtcagtgagtggtgaatgaatgtgaaggcctagggcattactgtatactactgtaggctttataaacacagcacacttagggtacacaaaatgcatattaaaacattttcttccttcagtatattaggcaataggaatttttcaagtccactataaatcttatcaaaccatggttgtatatgcagttgaccgaaacattgttattggacacataactatagttgaaagaataagcaaaaagtctatctaggtgtgctgtcttgagcaacttttaattattctcctgtcctgcaatatgagttaatcttctctgatcgatgtagattccaggaaggggtgtccaggacaattaccttccttctggagaaacttcccttaatcaaataagagaacttcaaagaaaatccctccctgtgctttggaagggaagggaggtgggcagcagtgggtcagagatagacctttgttctcttatttctgaggcccttcagtctcctttattcaaagcactcagcatgccaaagcaccctattttagggtatctttttctgagccctaaacactgtgttggggatgtcaactgtgacaggaaaatatcttggggccccagaatcactaaggaaaactcaagcttagggaaacttcttagggcaaacccacctcccactctattcaaagttatctctctgctcactgagatagatacatatctgattgcctcctttggaaaggctaatcagaaactcaaaagaatgcaactgtttgtgtctcacctatctgtgacctggaagctccctccccactgaaccaatgttcttcttacatatattgattaatgtcttatgtctccctaaaatgtataaaaccaaggtatgccccaaccatcttggccacatgtcatcaggacttcctgagtctgtgtcacagtgtgtcctcaaccttggcaaaataaactttctaaattaactgagacctgtctcggattttctgggttcacattttggaaaccatgaatggattctgggtggagatgcccctgacccttgacaaatctatcggtgcttggtaccagcatgagctaactttatggctcaaaccaataggacaatttgctgaggtctgagaggactccctccagaaaatccctgatctcttaaaatttggta

SEQ ID NO: 711 - DNA, 1876 bp, Homo sapiens
ctctaaagaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcctttagag

SEQ ID NO: 712 - DNA, 2444 bp, Homo sapiens
agcaggagggtgggaccaagggtgctgctggaccaaggatgggactgggccaagggtggggctgggaagcatcctgttttgcatgtttgatcaggagctgctgccaagttgtgactttcactttcccttttgggttccagggtatatctcagagcctggagaacgtgtctggttattatgcagatgcacggctggaggtgggatccacacagctcagaacagctggatcttgctcacactctttcaagagaagcttccttggacaaaaggaccctgccttggtgtgagagtgagggcagagggagctggagcaagtagaatttctctaaataccagctggctggggcccaggagattaaaaaacaccgggctaggttggtcttggcatttgctgacacgcaaagggattgcagagatccagcccctccaacctccctctgtccacaggtggctcacattcagtcccacaatttgctttctcctcctcaagggttaagaaaaaaaacgaacccttccagtcaggtcagtgactggagagctccatggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaa

SEQ ID NO: 713 - DNA, 2328 bp, Homo sapiens
agcaggagggtgggaccaagggtgctgctggaccaaggatgggactgggccaagggtggggctgggaagcatcctgttttgcatgtttgatcaggagctgctgccaagttgtgactttcactttcccttttgggttccagggtatatctcagagcctggagaacgtgtctggttattatgcagatgcacggctggaggtgggatccacacagctcagaacagctggatcttgctcacactctttcaagagaagcttccttggacaaaaggaccctgccttggtgtgagagtgagggcagagggagctggagcaagtagaatttctctaaataccagctggctggggcccaggagattaaaaaacaccgggctagggttaagaaaaaaaacgaacccttccagtcaggtcagtgactggagagctccatggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaa

SEQ ID NO: 714 - DNA, 2215 bp, Homo sapiens
agcaggagggtgggaccaagggtgctgctggaccaaggatgggactgggccaagggtggggctgggaagcatcctgttttgcatgtttgatcaggagctgctgccaagttgtgactttcactttcccttttgggttccagggtatatctcagagcctggagaacgtgtctggttattatgcagatgcacggctggaggtgggatccacacagctcagaacagctggatcttgctcacactctttcaagagaagcttccttgggttaagaaaaaaaacgaacccttccagtcaggtcagtgactggagagctccatggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaa

SEQ ID NO: 715 - DNA, 2118 bp, Homo sapiens
agcaggagggtgggaccaagggtgctgctggaccaaggatgggactgggccaagggtggggctgggaagcatcctgttttgcatgtttgatcaggagctgctgccaagttgtgactttcactttcccttttgggttccagggtatatctcagagcctggagaacgtgtctggttattatgcagatgcacggctggaggtgggatccacacagctcagaacagctggatcttgctcacactctttcaagagaagcttccttgaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaa

SEQ ID NO: 716 - DNA, 3627 bp, Homo sapiens
actctggggaaaggagggtacaaccacatgtaaattttattataatgatggtataatgaacttggggtgacctgagggcatgtttttgtgttactgggcatgtgcccctttaggagacttccacctgtgccttactttctctttctttgggatgtgctggccacagactttaccaaaaactccatccattaggatggcattaggacggttctggggctaaacttaggtgggccaggggctgtttcactgtcagcctttctactctcttttcttacccactcctagctgctaatgtctatttaactacctaatatttccccctttagagaaaaaaagccaaatttttgggtagatcggtgacaattaatctggctacttcctgctgacaagaggcagtggtaataattgggttctcttttttgctctcttgtagctggtaggttgggcagagaaaagtggtggccatccaaggggcccacgtagatatcagacatggttgagacctcgcggtaaccttgtgtagaatcatttggagttttatggattctaggtgggaagaaacaaaacaaccttgtaaatcaaatgagcatcgtttgaaagctataagttgtataaagctgttttaggaccaagaaagggggctaaccaggaaaaccaggaccagttgttaaatttccaccagtcaaagcctcctgaaactctgttttccattaacttgttggccctgtctgtaatttttttaagttggtttgcactttacctgattggttgatgaaaacagcaatgtttatcaagtgttgcacaagctcccccttgattggctgtgagcaaattaaaagctcatcaatttcataagactatgcttgctaatgaagcaatttgttctgaaagggtattgacctggttagttagattaataatttgttgagtaatttttaagaagagtttctgggcagtaaaaatggagttaaggaggtcctccagttcccgtgccaataccagccagaacgccaattatagtcagtgctgttaaaactcctctttcagttttaccagattgagcgtgtatagggaggggaatgctatcgataagagtgagtttggggatgatgtaaactagggccaaatccccgtttaattagcagacaagcagagatatgccttgtttctatacaaaaatgtgatttgtcatgttaagacaaatatcaacagtgatactaaagtagggtttttccatgctgtgtaagtctgctttaataccctcagaagtggaagtcaaggctagttcatgtaatgggggaacacaggcagtacttgacagaatgaaagaggaatcaaaagcccaattagaggaaggagtgatgggatcccaaccaatattgtgaaattatggggagctgcagttttttgcaatgattttgcccgaagttgtgagactgaaaccagaagttgttatgtttaaaatgatattctggtgtgggtctggggaaaagggtagatccagaatagctggcttctttccacatagtggttctgttggggggcttgggaaatgaataaaacacaaagaagaattagaatatcaggtgaaggtagcaggtgctcctggcagaagaacccacataaggaagtgtccagaagccacacagggtatatctcagagcctggagaacgtgtctggttattatgcagatgcacggctggaggtgggatccacacagctcagaacagctggatcttgctcacactctttcaagagaagcttccttgaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaa

SEQ ID NO: 717 - DNA, 3564 bp, Homo sapiens
actctggggaaaggagggtacaaccacatgtaaattttattataatgatggtataatgaacttggggtgacctgagggcatgtttttgtgttactgggcatgtgcccctttaggagacttccacctgtgccttactttctctttctttgggatgtgctggccacagactttaccaaaaactccatccattaggatggcattaggacggttctggggctaaacttaggtgggccaggggctgtttcactgtcagcctttctactctcttttcttacccactcctagctgctaatgtctatttaactacctaatatttccccctttagagaaaaaaagccaaatttttgggtagatcggtgacaattaatctggctacttcctgctgacaagaggcagtggtaataattgggttctcttttttgctctcttgtagctggtaggttgggcagagaaaagtggtggccatccaaggggcccacgtagatatcagacatggttgagacctcgcggtaaccttgtgtagaatcatttggagttttatggattctaggtgggaagaaacaaaacaaccttgtaaatcaaatgagcatcgtttgaaagctataagttgtataaagctgttttaggaccaagaaagggggctaaccaggaaaaccaggaccagttgttaaatttccaccagtcaaagcctcctgaaactctgttttccattaacttgttggccctgtctgtaatttttttaagttggtttgcactttacctgattggttgatgaaaacagcaatgtttatcaagtgttgcacaagctcccccttgattggctgtgagcaaattaaaagctcatcaatttcataagactatgcttgctaatgaagcaatttgttctgaaagggtattgacctggttagttagattaataatttgttgagtaatttttaagaagagtttctgggcagtaaaaatggagttaaggaggtcctccagttcccgtgccaataccagccagaacgccaattatagtcagtgctgttaaaactcctctttcagttttaccagattgagcgtgtatagggaggggaatgctatcgataagagtgagtttggggatgatgtaaactagggccaaatccccgtttaattagcagacaagcagagatatgccttgtttctatacaaaaatgtgatttgtcatgttaagacaaatatcaacagtgatactaaagtagggtttttccatgctgtgtaagtctgctttaataccctcagaagtggaagtcaaggctagttcatgtaatgggggaacacaggcagtacttgacagaatgaaagaggaatcaaaagcccaattagaggaaggagtgatgggatcccaaccaatattgtgaaattatggggagctgcagttttttgcaatgattttgcccgaagttgtgagactgaaaccagaagttgttatgtttaaaatgatattctggtgtgggtctggggaaaagggtagatccagaatagctggcttctttccacatagtggttctgttggggggcttgggaaatgaataaaacacaaagaagaattagaatatcagggtatatctcagagcctggagaacgtgtctggttattatgcagatgcacggctggaggtgggatccacacagctcagaacagctggatcttgctcacactctttcaagagaagcttccttgaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaa

SEQ ID NO: 718 - DNA, 2545 bp, Homo sapiens
gtgctggggagcagcgtgtttactgtgcttggtcatgagctgctgggaagttgtgactttcactttccctttcgaattccagggtatatctgggaggccggaggacgtgtctggttattacacagatgcacagctggacgtgggatccacacagctcagaacagttggatcttgctcagtctctgtcagaggaagatcccttggacaagaggaccctgccttggtgtgagagtgagggaagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagaccagcagcacaggcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcatcctgaccctcctcggcctgggtctggcacccttcacagaaggaatcagttttgtgctcttggacactggcatgggtctgggagcagcagctgctgtggctgggattacctgcagtgtggtagaactagtaaacaaattgcgggcacgagcccaagcccgcaacttggaccaaagcggcaccaatgtagcaaaggtgatgaaggagtttgtgggtgggaacacacccaatgttcttaccttagttgacaattggtaccaagtcacacaagggattgggaggaacatccgtgccatcagacgagccagagccaaccctcagttaggagcgtatgccccacccccgcatatcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagacttttttttttttttttttttttttttgagatggagtctcgctctatcgcccaggatggagtgcagtggctcaatctcggctcactgcaaactccgcctcccgggttcacaccattctccggcctcagtctcccgagtagctgggactacaggcacctgccaccacgcccggctaatttttttgtattttcactggagacggggtttcactgtgttagccacgatggtctccatctcctgacctcgtgatctgcccacctcggcctcccaaagtgctgggattacaggcgtgagccaccgcgcctggccaaaatgcagacattttattagggggataaggagggcaaggtaaagcttatggaactgagtgttagtgactttggcatttgtgtagctgagcacagcaagggaggggttaatgcagatggcaagtgcaccaaggagaaggcaggaacactggagcctgcaataagggaggagagaggactggagagtgtggggaatgggaagaagtagtttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactaccgacccccccccaggtttgatgtccttccaagaataaagtctttccctggtgatggtctctcgctctgtctttccagcatccactctcccttgtccttctgggggtgtatcacagtcagccagtggcttcttcatgatggtggttggggtggttgtcatgtgacgggtcccctccaggttactaaagggtgcatgtcccctgcttgaaccctgagaggcaggtggtaggccatggccacaatccccagctgaggagcaggtgtccctgagaacccaaacttcccagagagtatctgagaaccaaccaatgaaaacagtcccatcgctcttagccggtaagtaaacagtcagaagattagcatgaaagcagtttagcattgggaggaagcacagatctctagagctgtcctgtcgctgcccaggattgacctgtgtgtaagtcccaataaactcacctactcaccaa

SEQ ID NO: 719 - DNA, 2686 bp, Homo sapiens
atcagacagtaaaacaggggcagagcctggaattgcactgaggcttgagtctgacttctctcccccacctgctgtgcccttaaactgcagagatcggggcgggggttggggggcaagcggctcagatgggttcaaaaaactccccaggctcaactctggttctgactgcctgagacatgggcagctgacacagcagaccttgaatcctgaggatgtgaggcagggtatatctgggaggccggaggacgtgtctggttattacacagatgcacagctggacgtgggatccacacagctcagaacagttggatcttgctcagtctctgtcagaggaagatcccttggacaagaggaccctgccttggtgtgagagtgagggaagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagaccagcagcacaggcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcatcctgaccctcctcggcctgggtctggcacccttcacagaaggaatcagttttgtgctcttggacactggcatgggtctgggagcagcagctgctgtggctgggattacctgcagtgtggtagaactagtaaacaaattgcgggcacgagcccaagcccgcaacttggaccaaagcggcaccaatgtagcaaaggtgatgaaggagtttgtgggtgggaacacacccaatgttcttaccttagttgacaattggtaccaagtcacacaagggattgggaggaacatccgtgccatcagacgagccagagccaaccctcagttaggagcgtatgccccacccccgcatatcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagacttttttttttttttttttttttttttgagatggagtctcgctctatcgcccaggatggagtgcagtggctcaatctcggctcactgcaaactccgcctcccgggttcacaccattctccggcctcagtctcccgagtagctgggactacaggcacctgccaccacgcccggctaatttttttgtattttcactggagacggggtttcactgtgttagccacgatggtctccatctcctgacctcgtgatctgcccacctcggcctcccaaagtgctgggattacaggcgtgagccaccgcgcctggccaaaatgcagacattttattagggggataaggagggcaaggtaaagcttatggaactgagtgttagtgactttggcatttgtgtagctgagcacagcaagggaggggttaatgcagatggcaagtgcaccaaggagaaggcaggaacactggagcctgcaataagggaggagagaggactggagagtgtggggaatgggaagaagtagtttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactaccgacccccccccaggtttgatgtccttccaagaataaagtctttccctggtgatggtctctcgctctgtctttccagcatccactctcccttgtccttctgggggtgtatcacagtcagccagtggcttcttcatgatggtggttggggtggttgtcatgtgacgggtcccctccaggttactaaagggtgcatgtcccctgcttgaaccctgagaggcaggtggtaggccatggccacaatccccagctgaggagcaggtgtccctgagaacccaaacttcccagagagtatctgagaaccaaccaatgaaaacagtcccatcgctcttagccggtaagtaaacagtcagaagattagcatgaaagcagtttagcattgggaggaagcacagatctctagagctgtcctgtcgctgcccaggattgacctgtgtgtaagtcccaataaactcacctactcaccaa

SEQ ID NO: 720 - DNA, 7274 bp, Homo sapiens
atggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacacctattcaggcctgttctgtgtggtcatcaatccttacaagaacctgcccatctactctgaagagattgtggaaatgtacaagggcaagaagaggcacgagatgccccctcacatctatgccatcacagacaccgcctacaggagtatgatgcaagaccgagaagatcaatccatcttgtgcactggtgaatctggagctggcaagacggagaacaccaagaaggtcatccagtatctggcgtacgtggcgtcctcgcacaagagcaagaaggaccagggcgagctggagcggcagctgctgcaggccaaccccatcctggaggccttcgggaacgccaagaccgtgaagaatgacaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggctctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgctacga

SEQ ID NO: 721 - DNA, 1342 bp, Homo sapiens
gaggaagtgacgacaggcgtgcccttgacaggcagggagggctaggctgtgcatccctccgctcgcattgcagggagatggctcagcgacttcttctgaggaggttcctggcctctgtcatctccaggaagccctctcagggtcagtggccacccctcacttccagagccctgcagaccccacaatgcagtcctggtggcctgactgtaacacccaacccagcccggacaatatacaccacgaggatctccttgacaacctttaatatccaggatggacctgactttcaagaccgagtggtcaacagtgagacaccagtggttgtggatttccacgcacagtggtgtggaccctgcaagatcctggggccgaggttagagaagatggtggccaagcagcacgggaaggtggtgatggccaaggtggatattgatgaccacacagacctcgccattgagtatgaggtgtcagcggtgcccactgtgctggccatgaagaatggggacgtggtggacaagtttgtgggcatcaaggatgaggatcagttggaggccttcctgaagaagctgattggctgacaagcagggatgagtcctggttcccttgcccgcgtgggaccccaatagaactcagcccttccatgccagcccttcctgctgcctccctcctgtctggctcctggggcccatgcttagagcccaggctccagccctgagtgcttccgagctggcggactgcccaggggccatcagaggatggtggtgctgctgctgatccggggaccgctgtcttccctcccatacgcctttcatccctccttctagggcctatggcagttctcccaggatgtgtggcgagagcctgggccagcccacagcgttcctagtcaggcagccacaccttggtcctcatcttggtcccttccaatctgaaacctcgtgcctggctcgtctgccacctacatttctctttccagctgctgttttgtaaaaagaaaaagaaaaaagaagcccaaactagtgagagtaatatctaattatctcattttttgtaggtctgtgataaagaacttagtcatcccttccacctcctactgtgaagaacagaccctgggtcccacactgaaatcccctctagtcacccattcccaccccccagggagctgcctcccaggcagggggtgcagaaaatgattgatgggctggggaaccctggagagcctcgactccggaagtctcaaggtgcctcctcctctccttagctggcccgttggttttctgagcagggggctgaactgtgaacaagtcagacaaataaagcaagggtctgcaccatcaaaaaa

SEQ ID NO: 722 - DNA, 1342 bp, Homo sapiens; identical to SEQ ID NO: 721

SEQ ID NO: 723 - DNA, 2169 bp, Homo sapiens
gagcttcgattgcgcggccgccaagtttcagtgatgaacgccctctttgggcgtccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctttccctcaaaaaaaaaaaaaaa

SEQ ID NO: 724 - DNA, 1167 bp, Homo sapiens
gccaacttctccagccggccggggcgagcgccagcgcggcgtccggggcgagtgacacgcagagctgaagccatggttcatcaggtgctctaccgggcgctggtctccaccaagtggctggcggagtccatcaggactggcaagctggggcccggcctgcgggtgctggacgcgtcctggtactcaccaggcacccgagaggcccgcaaggagtacctcgagcgccacgtacccggcgcctctttctttgacatagaagagtgccgggacacggcgtcgccctacgagatgatgctgcccagcgaggctggcttcgccgagtatgtgggccgcctgggcatcagcaaccacacgcacgtggtggtgtatgatggtgaacacctgggcagcttctatgctccccgggtctggtggatgttccgtgtgtttggccaccgcaccgtatcagtgctcaatggtggcttccggaactggctgaaggagggccacccggtgacatccgagccctcacgcccagaaccggccgtcttcaaagccacactggaccgctccctgctcaagacctacgagcaggtgctggagaaccttgaatctaagaggttccagctggtggattcaaggtctcaagggcggttcctgggcaccgagccggagccggatgcagtaggactggactcgggccatatccgtggtgccgtcaacatgcctttcatggacttcctgactgaggatggcttcgagaagggcccagaagagctccgtgctctgttccagaccaagaaggtggatctctcgcagcctctcattgccacgtgccgcaagggagtcaccgcctgccacgtggccttggctgcctacctctgcggcaagcctgatgtggccgtgtacgatggctcctggtccgagtggtttcgccgggcccccccagagagccgtgtgtcccagggaaagtctgagaaggcctgagccgtgacctcttctgcttactgtaactgcggccggtttagtgaccccatgacttacagccggttcttacctcttaggtgaaggagatgacatgtttttagaattgctgtgcaaggctcaccctctctctgtcaacactggaataaactttgccttttctgaaaaaaaaaaaaaaaaaaaaaaaaaaaaaaaaaaaaaaaa

SEQ ID NO: 725 - DNA, 1349 bp, Homo sapiens
gtctcctccctttggtccgctgcaggttggtggcgggaggaggggacagctgcgggcgcggggagggggcgccgcgccgcgggggccatggcggagccaggaagccgggagtccgagacccgggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaatcttgta

SEQ ID NO: 726 - DNA, 1854 bp, Homo sapiens
agactgcgggcctgcggggaagggcgaagcggggcgggaccgggggcgggagcagcgcggggcgggaccctacccgcggcccacgcggagccaggaggcgcggactacagctcccggcctgccccgcgtgcggtccccgcccgcccccagcgcccgggaggaggatgcagacgccgcggccggcgatgaggatggaggccggggaggcagcgccgccggcgggggcgggcggccgcgccgcaggcggctggggcaagtgggtgcggctcaacgtggggggcacggtgttcctgaccacccggcagacgctgtgccgcgagcagaagtccttcctcagccgcctgtgccagggggaagagctgcagtcggaccgggatgagaccggggcctacctcattgaccgtgaccccacctacttcgggcccatcctgaacttcctccggcatggcaagctggtgctggacaaggacatggctgaggagggggtcctggaggaagccgagttctacaacatcggcccgctgatccgcatcatcaaagaccggatggaagagaaggactacacggtcacccaggtcccacccaagcacgtgtaccgcgtgctgcagtgccaggaggaggagctcacgcaaatggtctccaccatgtctgatggctggcgcttcgagcagctggtgaacatcggctcctcctacaactacggcagcgaggaccaggcagagttcctgtgtgtggtgtccaaggagctccacagcaccccaaacgggctgagctcagagtccagccgcaaaaccaagagcacggaggagcagctggaggagcagcagcagcaggaggaggaggtggaggaggtggaggtggaacaggtgcaggtggaggcagatgcacaggagaaaggttcccgtccgcaccctctcagacctgaggctgagcttgcagtgagggcttctcctcggcccctcgcccgcccccagagctgccatccctgctgttacaagccagaggcacccggatgtgaggccccagatcacctccagggacttggggttcccatctgaaatcctttatttttgtaccatggggtgggccccgggcctgagaaggaagaagcaccctctccccggcctcctctgtctgcacccgtggggctgtgacttactcctgcctccaggggcggggcggggcccccctgggacctcttaaggcccaaggtgggccccaggacctctgggcagagtggactgctcatggcagatgtgtggcaatgtctggctgtgtctctccggcacctgcgtcccctctcccgggctcccctgctgcatggtggatgtgctccttcctggcccggtcacattgcctccttgagccttagtccagggggtcactcctcccaccccacctacctcacagggttgttgtgagggtgcacagaggagcaaagtccctgaaggccctcaggcagtatataggggccgcccaccttcagctgccctgggatgggaaggacccagcccgacccctgggcataacactgtgtttgcaaatggagattcaggtattggggatgcaggttgtggggagctggcctggcagagtaggggtagttggcttggccttctctttggtgatcccacccccagccatttgcattgctggcccagcgcctggcctggggggcggggagaggcagcagaaggggctgggcaggggcggtggaggactcaggaactgcccggggagagtgggtatggcggctgagccaggggccctcctgtgtttgacttcccgggatgggtccttgcttctcagctgtgtccgaccccaccatgtaataaaacccaaaggaacagccca

SEQ ID NO: 727 - DNA, 2040 bp, Homo sapiens
ccatggctcagcctctgggtccagagcctcagctcctacctcttccctccttgccagcccctgatgcctgccagacttttgcctctgctggagcccctgcctgaccagcttcccctccctgtctggttgggatttgggggctgagctgtctggggtcccagggccaaccaatgcagtgccggctcccgcggggcctggctggagccctcctcaccctcctgtgcatggggctcctgtgtctgcggtaccacttgaacctgtccccgcagcgggtacaagggacccccgagctgagccagccgaacccggggccccctaagctacagctacacgatgtcttcattgcagtgaagacgacccgggctttccaccgcttgcgcctggagctgctgcttgacacgtgggtttccaggaccagggaacagacatttgtcttcaccgacagcccagacaaaggcctccaggagagactggggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcactcccacctggagaccctgcagctgctgaggactgcacagctcccagaacaggtcaccctcagctacggtgtctttgaggggaaactcaacgtcattaagctacagggccccttctccccggaggaggacccctccagatttcgctccctccattgtctgctctatccagatacaccctggtgtccccagctgggtgcccgatgaatcctgaactgctgggcaaaggttgggcagagacttctgggtgtgccttggctcccaaggtggcactgtgggtccctggcaagtgtcttgtgataggcagtccctggcagggccttcgggtggttggcaagcccaggatctgagtggcaattggcactgaaggcaccccaggcccctgggaggtgagttagacagcccaggggaccaggtggaccaggtggtggccagagaggctccaggggctagactccctcaggaggctgaattgaaaaagggcagggggcacttgagctgggctggggctcaggggtcctaaccctttaggcagtgacatggcctctgggtggggtctggccgttggccctggctaatgtctctcagtcattcccctggggctcaagcgctgggccgcccactcctgcctccctcatctgtgtcccgagttcctgaagggacatgggtggaatgatggcagaatccagggtctgcagcacctgctgttgttgccaaccagtctcccaaagctccttgctccccaccccttgcgaacaggaccagattttgtttggagcctcagcatgccggggcccagatgatggagcataacgggtcccagccaattgtgatgatcctttttgctcatttcccagcctttcttgctgttaggggctaccatgggaccagctctggccagagggaactaagcaaatccaatagagatgtttctggggaaggttttgcagcccactccccatcttcctgctataaatgtgggtgtgatggctggatctggggcagccaccttgctaccatgaaggaaaggccaagacaatcatccacagctattccctccagcatctggttctgtacaaaaattaaatgcttatttgtttaagtcaaaaaa

SEQ ID NO: 728 - DNA, 3908 bp, Homo sapiens
gccatgccgggccgggcggaggcgggggaggccgaggaggaggccggggccggctcggggtctgaggcggaggaggacgcgctgtgggagcgaatcgagggcgtccggcatcggctggctcgcgccctgaacccggccaagctcacgccgtatctgcgccagtgccgggtcatcgacgagcaggacgaggaggaggtgctgagcacctaccgcttcccgtgccgcgtcaaccgcaccgggcgcctgatggacatcttgcgctgccgtggcaagaggggctatgaggccttcctggaagccctggagttctactaccccgaacacttcacgctgctcacgggccaggaacccgcccagcgctgctccatgatcctcgatgaggaggggcctgagggcctgacccaattcttgatgacagaggtgcgacggctgcgggaagctcgcaagagccagctgcagcgggagcagcaactgcaggcccggggccgggtgctcgaggaggagcgggcagggctggagcagcggctgcgggaccagcagcaggctcaggagcgctgtcaacggctgcgggaggactgggaggcgggcagcctggagctgctgcggctcaaggatgagaactacatgatcgccatgcgcctggcacagctcagtgaggagaagaactcggctgtacttcgcagccgtgacctgcagctggcggtggatcagctcaagctcaaagtgagtcggctggaggaagagtgtgcactgcttcgaagggccaggggcccgccccctggggcagaggagaaggagaaggagaaggagaaggagaaggagccagacaatgtggaccttgtctctgagctgcgtgctgagaaccagcagctgacggcgtcactgcgggagttgcaggagggcctgcagcaggaggcgagccggccgggggccccgggctccgagcgcatcctgctggacatcctagagcatgactggcgggaggcgcaggacagcaggcaggagctgtgccagaagctgcatgccgtgcagggggagctgcagtgggccgaggagctgcgcgaccagtacctgcaggagatggaagacctgcggctcaagcaccgcacgctgcagaaggactgtgacctgtacaagcaccgcatggccactgtcctggcccaactggaggagattgagaaggagcgagaccaggccatccagagccgtgaccggatccagttgcagtactcacagagcctcatcgagaaggaccagtaccgcaagcaggtgcggggcctggaggcggagcgggatgagctgctgacaacgctcaccagcctggagggcaccaaggctctgctggaggttcagctgcagcgggcccagggtggcacctgcctcaaggcctgtgcctcctcccattccctgtgctccaacctcagcagcacttggagcctgagcgagttcccctcccctctgggaggcccagaagcaactggggaggcagctgtcatggggggacctgagcctcacaactcggaggaagccacagacagtgaaaaggagatcaatcggctctccatcctgcccttcccccccagtgccggctccatcctccgccggcagcgtgaggaagaccccgcaccccctaagagatccttcagcagcatgtcagacatcacagggagtgtgacacttaagccctggtcccctggcctctcttcgtcctcatcctctgacagcgtgtggcctttgggaaagccggaaggcctcctggctcggggctgtggcctggacttcctcaacaggtctctggctattcgggtgtctggccggagccccccagggggcccagagccgcaggacaagggaccagatggactgtcgttttatggggacagatggtctggggctgtggtgcgcagggtgctgtctgggcctgggtccgccaggatggaaccaagagagcaaagggtggaagctgctggtctggagggggcgtgcctggaagccgaggcccagcagagaaccttgctctggaatcaggggtccacactcccctccctgatggactcgaaggcctgccagtccttccacgaggccctagaagcctgggcaaagggaccaggtgccgagcccttctacattcgtgccaacctcaccttgcctgagagggcagatccccatgccctttgcgtgaaagcccaagagatccttcgactggtggactcggcatacaagcggaggcaggaatggttctgcacccgggttgaccccctcactctgcgggacctggaccggggcaccgtgcccaattatcagagagcccagcagctcctagaagttcaggagaaatgcctgccctccagccggcaccgaggcccccgcagtaatctgaagaagagagccctggaccagctgcggctggtgaggcccaagcccgtgggggcgcctgcaggggactccccggatcagctgctgctggagccctgtgcagagccggagcggagcctcagaccctacagtttggtgcggccgctactggtgtctgccctgcggcccgtggtgctgttgcctgagtgcctggcgccccggctcatccgtaacctgctagacctgcccagctcccggctggacttccaagtgtgcccagcggaaagcctctctggggaggaactgtgcccatcctcagcgcctggagcccccaaggctcagcctgccacccctgggctaggcagcaggatccgggccatccaggagtctgttgggaagaagcactgcctgctggagctgggtgctcggggtgtgcgggagcgggtgcagaacgagatctaccccatcgtcatccacgtggaggtgactgagaagaatgtccgggaagtcaggggtctgctgggccggccgggctggcgggactcagagctgctgcggcagtgccgtggctcagagcaggtgctctgggggctgccctgctcctgggtgcaggtgcccgcccatgagtggggacacgcagaggagctggccaaggtggtgcgcggccgcatcctgcaggagcaggcccgcctcgtgtgggtggagtgcggcagcagcagaggctgccccagcagcagtgaggcctgaggctcatctgatacctgcaccttctccccaagccagcgtggaccctggtgtctatggtgaagctgggccctcccaccctgagccttcctagacccttggactctcagatgcagggcccttggctctggcctctcacccccaaggctgtctctggccctgccgagcctatgggagtcccgggacagagtgcccactcccctctacttgctgctctgggcctccccacctttcctggggtctccacattcccactagtgggtcttatgtgtgtctgtgtcttctccttaaacactcgccctggagtctgttctcacacctgtgcgcaggtttgcacactcaagttctcatgggcaggctcaggtctgtcccgctgccctgggcacgaggtctcctgaggacctgggcctgttctgctcctaggagacctgagcccgttaccgcgtgactcccaccatccagctcgcgctcctcgtggattcagccatgcatggactggggtgttccctggcccatggtcacctgtgcccctcgtgtctcctcacatgggtgtctgtggttctctcctgtgtaaatgtcacgccccacccctgtttcatgtgggcactaacacgtgtgcgttcctggcgggcacacacaggaccgtgcctcacagggcccactccctgcctatgcctccctcttggggggccgaggagggcggctgctctgtcatgagaatgtacggcccgtggatgattaacgggcctttttcacttagaagctgcacattatggagcattaaacacttttgtcataaaaaaaaaaaa

SEQ ID NO: 729 - DNA, 2800 bp, Homo sapiens
gggggccggtggcggatggagcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctgggagcacctcggccctgctggatctctcaggcctggatctcccgcctgcgggcaccacctacccagctatgcccacccgccctggcgagcaggccagccctgagcagcccagtgcctcagtttccctgcttgacgacgagctcatgtctctgggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctggaaaaaaaaaaaaa

SEQ ID NO: 730 - DNA, 2800 bp, Homo sapiens; identical to SEQ ID NO: 729

SEQ ID NO: 731 - DNA, 2434 bp, Homo sapiens
ctgcaggtagaacagcggctggagccggccaagcgggcagcccacaacatccacaagcggctgcaggcctgtctgcagggccagagcggggcagacatggacaagcgggtgaagaagcttcccctcatggctctgtccaccacgatggctgagagcttcaaggagctggaccctgattccagcatggggaaggccttggagatgagctgtgccatccagaatcagctggcccgcatcctggccgagtttgagatgaccctggagagggacgtcctgcagccactcagcaggctgagtgaggaggagctgccagccatcctcaaacacaagaaaagcctccagaagctcgtgtccgactggaacacactcaagagcaggctcagtcaggcaaccaagaattcaggcagcagtcaaggcctaggaggcagcccgggtagtcacagccatacgaccatggccaacaaggtggagacgctgaaggaggaggaggaggagctgaagaggaaagtggagcaatgcagggacgagtacttggctgacctgtaccactttgttaccaaggaggactcctatgccaactacttcattcgtctcctggagattcaggccgattaccatcgcaggtcactgagctcgctggacacagccctggctgagctgagggagaaccacggccaagcagaccactccccttcgatgacagccacccacttccccagggtgtatggggtgtcgctggcaacccacctgcaagagctgggccgggagattgccctgcccatcgaggcctgcgtcatgatgctgctttctgagggcatgaaggaagagggtctcttccgtctggctgctggggcctcggtgctgaagcgtctcaagcagacaatggcctcggacccccacagcctggaggagttctgctccgacccgcacgctgtggcaggtgccctcaagtcctatctgcgggagctgccagagcctctgatgaccttcgacctctatgatgactggatgagggcagccagcctgaaggagccaggggcccggctgcaggccctccaagaggtgtgcagccgcctaccccccgagaacctcagcaacctcaggtacctgatgaagttcctggcacggctggccgaggagcaggaggtgaacaagatgacacccagcaacatcgccatagtcctgggacccaacttgctgtggccacctgagaaagaaggggaccaggcccagctggatgcagcctccgtgtcttccatccaggtggtgggcgtcgtcgaggcgctgatccagagcgcagacaccctcttccctggagacatcaacttcaacgtgtcaggcctcttctcagctgttaccctccaggacacagtcagtgacaggctggcctctgaggaacttccgtccactgccgtgcccaccccagccaccaccccggctccggctccggctccagctccagctccggccccagccttggcttcagcagctaccaaggaaaggacagagtctgaggtgcctcccagaccagcctcccccaaggtcaccaggagtcccccggagacagctgccccagtggaggacatggctcggaggaccaagcgcccggcgccagcccggcccaccatgccgcccccccaggtctccggctcccgctcctcccctccagccccgcccttgccccctggctctggcagccctgggaccccccaagccctgccccgacgtctggttggcagcagcctccgagcccccacagtgccacccccgttaccccccacaccccctcagcctgcccggcgccaaagccggcgttcaccagcctcccccagcccggcctccccaggtccagcctcccccagcccagtctctttgagtaaccctgcacaggtggacctgggggctgccacagcagagggaggagcccctgaggctatcagtggggtccccactcccccagctatcccccctcagccccgccccaggagccttgcctcagagaccaactgagtggctggtttctccctaagcagccctcagcaccccctccctccccacctggccctcccaggacagctctcgccccccacaaaggggcatgggcctccagcctttgcccacaagtgcctcagtgcccactgggtcggcccccatggccaggagggctcaggacaatcctctatttcctgaccttttcctcgtccaccctgggcttggggacccccccaccggactctccactctccggcaggtcctaggggagccaccggaaggaaggagaggtttgcctgctcctacgggactgattcttctcttgccgacatgttttttgtaaggctggtaaataaattattttggacaaaaaaaaaaaaaaaaaaaaaaaaaaaaaaaaaaaaaaaaaaaaaaaaaaaaaaaaaaaaaaaaaaaactcggg

SEQ ID NO: 732 - DNA, 1470 bp, Homo sapiens
gctcgggcgaggtaggagcgatgtggcctgggaacgcctggcgcgccgcactcttctgggtgccccgcggccgccgcgcacagtcagcgctggcccagctgcgtggcattctggagggggagctggaaggcatccgcggagctggcacttggaagagtgagcgggtcatcacgtcccgtcaggggccgcacatccgcgtggacggcgtctccggaggaatccttaacttctgtgccaacaactacctgggcctgagcagccaccctgaggtgatccaggcaggtctgcaggctctggaggagtttggagctggcctcagctcggtccgctttatctgtggaacccagagcatccacaagaatctagaagcaaaaatagcccgcttccaccagcgggaggatgccatcctctatcccagctgttatgacgccaacgccggcctctttgaggccctgctgaccccagaggacgcagtcctgtcggacgagctgaaccatgcctccatcatcgacggcatccggctgtgcaaggcccacaagtaccgctatcgccacctggacatggccgacctagaagccaagctgcaggaggcccagaagcatcggctgcgcctggtggccactgatggggccttttccatggatggcgacatcgcacccctgcaggagatctgctgcctcgcctctagatatggtgccctggtcttcatggatgaatgccatgccactggcttcctggggcccacaggacggggcacagatgagctgctgggtgtgatggaccaggtcaccatcatcaactccaccctggggaaggccctgggtggagcatcagggggctacacgacagggcctgggcccctggtgtccctgctgcggcagcgcgcccggccatacctcttctccaacagtctgccacctgctgtcgttggctgcgcctccaaggccctagatctgctgatggggagtaacaccattgtccagtctatggctgccaagacccagaggttccgtagtaagatggaagctgctggcttcactatctcgggagccagtcaccccatctgccctgtgatgctgggtgatgcccggctggcctctcgcatggcggatgacatgctgaagagaggcatctttgtcatcgggttcagctaccccgtggtccccaagggcaaggcccggatccgggtacagatctcagcagtgcatagcgaggaagacattgaccgctgcgtggaggccttcgtggaagtggggcgactgcacggggcactgccctgagctctgggtaaggacgagaagagccaaggtccgcctactgccacagggtcaaaggaggttttcgatcagcccagaccagaggctctgagccctgaaccaaagtcccagagctgggctgggacgtgacctgtgctgagggctgtgagaatgtgaaacaacagtgtgaaaattggctgtgaaaaaaaaaaaa

SEQ ID NO: 733 - DNA, 546 bp, Homo sapiens
gcgcgagtcgtagtgtcgctgtttgcgggtctccgcggcgggaccggggcgcagcggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggacgagctcatcatcaccgactgagctggagtcatcttcctgcccttgccccatgcccaattttcattctcactttatatgtgtaaataataaaatattcaactttcc

SEQ ID NO: 734 - DNA, 2670 bp, Homo sapiens
ggttgggatctgaggggtcctctctgtgcccatcacagtttgagcttcagggaaaagaagaagaggtctttgcccttcgtttttccacgggaggagaatcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaaaaaaaaaaaaaaaaaaaaaaaaa

SEQ ID NO: 735 - DNA, 2820 bp, Homo sapiens
gcgggcgggcgggcaggaggccgggaggagggaggcggcggcggcggcggcggcggcggcgagagcccagagccagagcccggccggggccgagcggagcgcggcggcggcggcggcggcggcggctgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaaaaaaaaaaaaaaaaaaaaaaaaa

SEQ ID NO: 736 - DNA, 1705 bp, Homo sapiens
gggcggcggcgcgcgggtgcgatcgcggagctgtgaggcgcaggcagggctctggggcacctagagaccggggccggagacgtggcagccgccctgcccgccagaaagtttcctagaagtttgctgggcgcgggcgcacgactgactggctggaccatgaacgtgttccgaatcctcggcgacctgagccacctcctggccatgatcttgctgctggggaagatctggaggtccaagtgctgcaagggcatctctgggaagagccagatcctgtttgctctcgtcttcaccaccaggtacctggacctgttcaccaacttcatctccatctacaacacagtaatgaaggtggtttttctcctctgtgcctatgttacagtgtacatgatatatgggaaattccgtaaaacttttgacagtgagaatgacacattccgcctggagtttcttctggtcccagtcattggcctttccttccttgaaaactacagtttcactctgctggagatcctctggactttctctatctatctggaatcagtggctatcctgccccagctcttcatgatcagcaagactggagaggctgagaccataactactcactacctgttctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaagtccttaagggaaagaagttaagtcttccaatgccaatctgaggaccttcagagacagtctacgccttaacaagcacatgaaggaaactattttgaatgttctctttggcaacttatccataatttgggatcaaatgttaaaaccagaaaagtgtttagtgtggatttcagcaaaacctgatcatcccacccagaagaccttctcatcaatagatcgcccttaaagacccattgtaaggtcataaaaaacctcggccacctgcacaaagatggtgcctcactgcaacaagaaaccttaaggtgtcttaccgacgaaataaaaaacataaatgattgttctccaaggcctgagggcaagactcatgatgagcaagtcaaccccaatctggaacaatgtccctcctcttagaatgtcccaactaaagaccagttaaaatattagggtacgttcttgtgaatttccactttccaggtagatgaccaaatttaggtggtcaagatataaaggtgtcagctagttttaagtgtgaaacttatttcactttcacactgccttcaggccagaagcaaaccaaatttaccaggtttggctggaggagttttgtgactcatcttttactggtttgaattttttcaaaccagtggctgatacctgccttgtacttagtaccttaataccaataacctaatggtacttaggcgagtaccatttgcacaatcactgttttacttatgagcagatacagatatatccaaacccttacctactaggtatcctgctagggttttcaattccaattcttgtattaagttttttcctttcagttttaggtgcgaaagtaatcagtcaatccaatatcccccatctttgtcttgaaacaaaaactgttttaagacgtctacgttgaattattcagagaattaagcaataaaagctcacacctta

SEQ ID NO: 737 - DNA, 929 bp, Homo sapiens
gggcggcggcgcgcgggtgcgatcgcggagctgtgaggcgcaggcagggctctggggcacctagagaccggggccggagacgtggcagccgccctgcccgccagaaagtttcctagaagtttgctgggcgcgggcgcacgactgactggctggaccatgaacgtgttccgaatcctcggcgacctgagccacctcctggccatgatcttgctgctggggaagatctggaggtccaagtgctgcaagggcatctctgggaagagccagatcctgtttgctctcgtcttcaccaccaggtacctggacctgttcaccaacttcatctccatctacaacacagtaatgaaggtggtttttctcctctgtgcctatgttacagtgtacatgatatatgggaaattccgtaaaacttttgacagtgagaatgacacattccgcctggagtttcttctggtcccagtcattggcctttccttccttgaaaactacagtttcactctgctggagatcctctggactttctctatctatctggaatcagtggctatcctgccccagctcttcatgatcagcaagactggagaggctgagaccataactactcactacctgttctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaaggtaggtcctgggatgacagcaatgctgacactggcctaaggagttactcatccatttaataagtattccagcagatacagatgtgaacagtcaagtctctgccatccacaatgcttgtgttctaatgcaagaagacaaatattttcaataaagaaacaaatgccataaa

SEQ ID NO: 738 - DNA, 2269 bp, Homo sapiens
cgccaaaccctgtggtcaacggcgcgcgggtctccaggctccgtgttctaggcccgagttagaatcctgtcagctgaggaggtcgggcggggcagaggggcttcaccttgaaaatctcggggagactgtgggtacgagggggaagtgattatttttctgttgcccacttttcaatatgaaggaggatcaagttgtggcggaagaaccaggattccaagatgaagaggaatctttgtttcaagatattgacctgttacagaaacatggaattaacgtggctgacattaagaaactgaaatcagtaggaatctgtaccatcaaaggtatacagatgacaacaagaagagctctatgcaatgtcaaaggactctcagaagccaaagtagacaagattaaagaggcagcgaacaaactaattgaaccaggattcttgactgcatttgagtatagtgaaaagaggaaaatggttttccatatcaccaccgggagccaggaatttgataagttactaggaggtggaattgaaagtatggcaattacagaagcttttggagaatttcgtactggaaaaacccagctttctcataccctctgtgtgacagctcaacttccaggagctggtggctacccaggaggaaagattatcttcattgatacagaaaatactttccgtccagatcgccttagggacattgctgatcgctttaatgtagaccatgatgcagtactggacaacgtactttatgcacgtgcatatactagtgaacatcagatggagctacttgattatgtagcagcaaagttccatgaagaagctggcatcttcaagctattgattatcgattcaataatggcactttttcgagtggatttcagtggccgtggggagttggccgaacggcagcaaaaattggcccagatgttgtcacgactccaaaaaatctcagaagaatataacgtggctgtttttgtgaccaatcaaatgactgccgatccaggagcaactatgacctttcaggcagatcccaaaaaacccattgggggacacattctggctcatgcttcaacaacaagaataagcttgcgaaagggaagaggagagctcagaattgccaagatttatgacagtcctgagatgcctgaaaatgaagccaccttcgcaataactgctggaggaattggggatgccaaggagtaggtggtgaattgatgcaaattgcttcttagtgcttattaggagctgaagaaatggaaaagcagtctccaatttcacatcttgaaatagaggttttttcccacatgttactaaagaaaagtcagcaaagagatttaaatcttatatttatcttaaaagtccctgatttatgataactatacattgtatgtaaattcagggatatgtatatgtatgtttgtgtgtgtgtgtgtttgtgtgtgtatacctgacatatatagtagatatatatacctattgaaattctctcactctgtgtatgtatatatacctatggaaaactagttgttgggaaaggagtacgtgattccctccctttcacttttcaaagtgagccactaaacagaaagtctaagagttcagaaatgtcccattctcctaaggactttcccttcaccatttttctagggtatagtgccactgacttacatagctagatgtttttccacaagaggatttaagggaggaatgtttataggacacacacacaaaagctctttctatttataatatcaaactgcatattcacctttatagcaacagaaaacagacattaaattaagccaaattttaaatcatttgactttgacaagcagaaattacttttaaaaaatgtatttatggctgggcgtggtggctcacacctgtaatcccagcactttgggaggccgaggcaggtggatcacttgaggtcaggagttcaagaccagcctggccaacatggagaaaccccatctctactaaaaatacaaaaattagccaagtgcagtggcatgtgcttgtaatcccagctactctggaggctgaggcaggagaattgcttgaacccaggaggcagagattgcggtgagccaagatggcaccactgcactccagcctaggtgacagagtgagactccgtctcaaaaaaaaaaaaaaaacttttttaaaatgttaaaattaatttaaatgtaaaatttctgaatactaatcttagaaatgtgtaaaagatattattttgattgttaaacaaataaaatcctgttttcaaaatgc

SEQ ID NO: 739 - DNA, 1194 bp, Homo sapiens
caaggtaactctgggctacagagtccttgctgggggttcggggagcgcttggaccccggcttctgggacgcgtcaggagaagggagcactggctttgctttcatcaggccaaagatgcctttctttgggaatacgttcagtccgaagaagacacctcctcggaagtcggcatctctctccaacctgcattctttggatcgatcaacccgggaggtggagctgggcttggaatacggatccccgactatgaacctggcagggcaaagcctgaagtttgaaaatggccagtggatagcagagacaggggttagtggcggtgtggaccggagggaggttcagcgccttcgcaggcggaaccagcagttggaggaagagaacaatctcttgcggctgaaagtggacatcttattagacatgctttcagagtccactgctgaatcccacttaatggagaaggaactggatgaactgaggatcagccggaagagaaaatgaagaccccagagacatttattggggagtaggatgtggctgagtgctttttttttggccagactagcggattcagtcctggaagagagtatcatataatgagacccacaggcactggcacccttgggttggcaatagaaggtgacatggaatggagaaaaccaagattccagatggggatagtaactagaaggtgcttcagatgcactgcctgcgggtgccagtctgaaaaccagaccgcacagaggcctggggctgctgatgagctttttggtgctctccacacacaagctcgcaaacacacatgtcccagaatagctctgttgggttgtgttgggagaagcggctggagttcattctctcacccccttatgttggtgtttggcgtgtgacagcagttctacagagctctgtgttggggtcatggatgagcggctctcttggctcttaaaggcaggcctctctcttcttgcctttaaagaatcctccttcctcacacctggcctcctctggcttcagcttctcagcagcaagcaccagccttccacaacaacactatatttttatgctactttcctgtttgcactactacttttttattaaacgatgttaaataaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 740 - DNA, 1092 bp, Homo sapiens
cagtcatggctgccgccgtcgctgctgccggtgcaggggaaccccagtccccggacgaattgctcccgaaaggcgacgcggagaagcctgaggaggagctggaggaggacgacgatgaggagctagatgagaccctgtcggagagactatggggcctgacggagatgtttccggagagggtccggtccgcggccggagccacttttgatctttccctctttgtggctcagaaaatgtacaggttttccagggcagccttgtggattgggaccacttcctttatgatcctggttcttcccgttgtctttgagacggagaagttgcaaatggagcaacagcagcaactgcagcagcggcagatacttctaggacctaacacagggctctcaggaggaatgccaggggctctaccctcacttcctggaaagatctagattgttattgctgtttgagctgtctcagtgggataagtttgaaattcaagtgtttgaactgctgataatttggatttttttttttttaactttggcacattgatctatctaaacccggtggggagaattatccccacattgtctcatggaaagactcaacttgcaactgtgccctccacactatccttacttctgtctccactctgataccagagtgcagccatgcagacggttattccagctctggtcacccgactcctttcaccaaattgctcctaactggaagatctcactttccccttgtggggtaggaaccgatgccagtgggagggatgtgcccctgaccattaacgactgtttttttttttttttttaaagaatggagttgttggggcgggacatgcacacaatgtgaaacagacaaaatgcattacacctgtagtgtaaagtggccactatgaatccctatgtatgagaggagggaggcaggctgcagcttcagccacagaatggggactatggaagacagcaggagctcatttcctctgcacattttggctgttagacctgtgtgtgtgtttaaaaaaagagaagtcagtgctcactttttgtatttaaatattaaaaatgattccaactgaaaaaaaaaaaaaaaaaa

SEQ ID NO: 741 - DNA, 3207 bp, Homo sapiens
cccacgcgtccgcccacgcgtccgcttacattttatgtgtttttttaaattctgcactttgacagtggtagcaaaataaaagtaatccaaaagttatttttctattgagaagagagaagaggtgggttttatttttttccttttgattccaatcttttctcccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcagggatgtcggtgtcattgccctcactaacgtcatgggcttcatcatgaatctgccctccagcctatgctggggtccactgaaactgcccctcaaaaggcagcactggatctgtgttcgagaggtgggaggggcctactacaacctcgactccaaactcaagatgcccgagtggattggaggcgagagcgagctcaggaagtttctaaaacatcatttgcgaggaaagaactgtgaactcctgctggtggtaccagaagaggtagaggctcatcagagttggaggaccgatgtgtaacagttctgcccaacctccctctcgcctcagccccttcagtcctctgtgacgtgctgtggcctctacagtgggtctgcccttgccacttccccaaacatctcatcaagtttttccccttcagatctgacagtgcaataggacagacgtgtggactgttataagaactactcagtgttttgttcctgggcaaggaaggtaggagttctgtgcacttaaggccagtggtcacaaacccttgttttatttaagagacagaggagaaagtggagcggggagggaatcctagcttattttcccttttctatgaggacttgacacaggttctgctgagttgtcactgctgctccagactcacctagagatgctgcctccactttccatcctgtctgggtctgaaaacagtgggtctgcagatagtgcccacaaaccccatgtgactggtttgaaggacccagagcataaaggtctctcaggaaaccatgtccaaaaccctagcagcggtacagcatgctgtctccaacccttatccccaggtttaagggtggtttatggccatacgtggaggttttttgttgttgtttttgagactgagtttcactcttgttgcccaggctggagtgcaatggcaccatctcggctcactgcaacctccacctcctggttcaagcgattctcaggcctcagcttcccaagtagttgggattacaggcgcctgccaccacacctggctaattttgtatttttagtagagatggggtttctccatgttggtcaggctggtctcaaactcccgacctcaagtgatctgcccgccttggcctcccaaagtgctgggattacaggcgtgagccaccgcacccggcagagttttataatgaaaaattaactaatattctagtatgaagtgaggaggatactgaacaggatgtggctaaagccaacctgggacagccatggggtggcttggtttcttcactccagtgttgtccctaccatttcgcagcattgatttaggaggctctgggacaaaagagaagccaaagagcagttttcccagttcactcactctggcaaaatcaggaaaaaaaagtctgcttttgacatcaaattccactaatttggggcagcgttgggtgaggaaagtattgtgaagacaggcttcttggagtaggggcagccacaattcagtagacactctaggctcggaggctgccactgtagttgccaagctcaggttgggtggttctgtgctgtatggatggaataggacctgggctggtcatcttcatgtcgtttcctctctgtatcaatggaagttcaacccgcccctacctcttcagatagttgtaggccacttttctcttgtaactttggaaaacaaaagaggagaaataagtatcataccatatgcgtgtctccaaagtggatgtggttgcctcaaggcaggtggcaggcaggggtgacctgctggccctcagatcaatggtcgtggcaggtctgagagctgtcccactggccagacttctctccagcagcaaagccagcctggggcttgcatgttgatcctgagcaagcttaacggggtgaagctgggctttctcccccctgtgactggagtgcatgttgacaccagcactttttctgcacatgtatcttcaatccaacaaggccgtttttttaatgctgagtaacaggccaccaagcggctactgcgttatatcttctcagcaactggccgcagtctcttctgcaccattttctacaccagacctgcttggcaccacagggagctcttttcctgccctgcacaatgacattccaaccaccaccagccagacattacagccaaccttgctgattgtcacaagcaggaccttggggccactggcactgtcagatagtaagccatttcttgggtagaggaggaaactcctctccacaaatccacttgggcctgtgcaaatggcacttgaaagagtccccatgcacttggagtccatgagccaatgggatatgcaaagacgcttaaacatttcagggctggtttctctgttcatatccaattctggtgcttaggaacagggacccatgctgatgcccaagggcaaaaagccccacttcctttaaggaagtgaacaggcctgaccctgatgcccaataacgggcaaccctaggctttttgtttttcttgcttttattcctttttgttgttggccttgtgctgcgtttgtttacaaaagatgtattttgtttaaccaaatattaaaaatggaaaactccaaaaaaaaaaaaaaaaa

SEQ ID NO: 742 - DNA, 3908 bp, Homo sapiens
ccgcccgcccgccttgtcccgcgtcgccgctcttcgcgtgcccgcgcgccccgggcccggccgctgtgtcgccctgagcggagcgccgcccgcgggatccccacgcggaaagggggcgcgccccggcggcggcctggcctcggacgcccccggccgggctagaagccgccgcggcagcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctcagagagcagcagggccagcgggcttgtggggcgcaaggccaccgaggacttcctgggctcttcctcgggctactcctctgaggacgactacgtgggctactcggatgtggaccagcagagttccagctcgcggctccgaagcgccgtctcacgggcgggctccttactctggatggtggccacttcgccaggccggctcttcagacttctctactggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcatgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtctggctgcggggaaggggcaagaaggcgggcaggccttcactgcagcactgagcctcaaatccgctctggagcatgaggctggatgcagtggtggtgaggccgccccgctccatcccgaggcagccagggtttgttttgcgctctcctgtcacaaatgctgcactattggttcttaagttttttatctccagatcctaatttatgcctatgcaaaaaataaatgacgcccaagagctg

SEQ ID NO: 743 - DNA, 3537 bp, Homo sapiens
ggagcgcagtcgctccgcgatggactcgccggtcccggcctctatgttcgcccccgagcccagctccccgggggcggccagggccgcggcggccgccgcccgactccacggcggctttgactcggactgcagcgaggacggcgaggcgctcaacggcgagccagagctggacctcaccagcaagctggttctagtgagccctacatcagagcagtatgacagcctacttcggcagatgtgggagaggatggacgagggatgcggagagaccatatatgtcattgggcagggatcagatgggactgagtatgggctgagtgaagctgacatggaggcctcctacgccacagtgaagagcatggcggaacagatagaggccgatgtcatccttctgcgggaacggcaagaagctgggggccgcgtgcgtgattacctggtccggaaacgagtaggagacaatgacttcctggaggtcagggtagcagtggtgggcaacgtggatgctggcaaaagcacgcttctgggggtcctgacacatggggagctggacaatggccgaggctttgcccgccagaaactcttccgccacaaacatgaaattgaatctggtcgcaccagcagtgtgggcaacgacattctgggctttgacagtgaaggcaatgtagtgaacaagcctgacagccacggcggcagcctggagtggaccaagatctgtgagaagtccacgaaagtcattaccttcatcgacttggctggtcatgagaagtacctgaaaaccactgtcttcggcatgacaggccatctgcctgacttctgcatgctcatggtgggcagcaatgctggcatcgtggggatgaccaaagaacacctgggcttggcactggcactcaatgtacctgtctttgtggtagtcaccaagattgacatgtgtcctgccaacatcctgcaagaaaccctgaagctgttacagcgcctgctgaagtcaccaggctgccggaagatccccgtgctggtgcagagcaaagatgatgtgattgtcacagcctccaacttcagctctgaaaggatgtgcccgatattccagatctccaacgttacaggcgagaacctagatctgctgaagatgttcctcaacctcctctccccccgcaccagctacagggaggaggagcctgctgagtttcagattgatgacacctactccgtcccgggtgtggggacagtggtttcggggacaacactgagaggcctgatcaagctgaatgacacgctgctgctgggcccagaccccttgggtaacttcctgtccattgctgtcaaatccatccatcgcaagcgcatgcctgtcaaggaggtgcggggtggccagacagcatcctttgcgctgaagaagatcaagcgctcgtccatccggaagggcatggtgatggtttccccacgtttgaatccccaagcctcctgggagtttgaggccgagattctcgtcctccaccaccccaccacaattagcccgcgctaccaggccatggtgcactgtgggagcatcaggcagacagccaccattctgagcatggacaaggactgtctgcgcactggggacaaggccactgtacacttccgcttcatcaagacccctgagtacctgcacatagaccagcggctggtgttccgggaaggccgcaccaaggctgtcggcaccatcaccaagctcctccagaccaccaacaactccccaatgaactccaagccgcagcagattaaaatgcagtcgacgaaaaagggccccctgacgaaacgagacgaggggggcccgtctggtgggccagcagtaggagcacccccacctggagatgaagcctcctctgtaggggcagggcaaccagctgcgtccagcaatctccagcctcagcctaagcccagcagtggaggccggcgacgagggggccagcgccacaaggtgaagtcccagggggcctgtgtgactcctgccagcggctgctgaaccttcccctggcccaccctcaccacccaaggggtcatcatctctggccaccactccaccagatgggcagagcagctatgaccgccacccagccctcccgctcaggccacagccggagcctccgcattgcccccacccccattttccaggggggttgtaatttataagctgacgaaggtagccagacttccggaggactgaccatctctcactgtcctccccaccttcttcctcactcacacattttttgtacatctgggcccttagtttttattctgtttattatatgtctctgtctctctctattgtgtgtgtgtgtgtgtgtgtgtgtgtgtgtgtgtgtgtggtgcaggagtgccacccccagggccctgtcaacctctcttttctcctccatggctgtctgcctgcgtatctgtctctgagaatcctcggggcggtcaggggatgtcaggaggggaaggagccgccctccctatcttgctgctcctcttggcactcaggggcaccttccatggagccagaccgggtggaggggcttctgggatttggtgtctgctgctgccagagcaggaacccccagtctaggacttgggcattttaacagggagaaagtagtggcttcccttttctctctctcctcctttttccctttaagcccacagattcaggtcatgccaaaagctctctggttgtaacctggagacatgtggaggggaatggcgatgggattataggactctccccatctcgggccctgaccctgacccttgccaccaacccaaagacagctggtgggtttccccttggagacaatcctgcgtttgcctgggccggccctggctgccctcagctttcgctgatctgcccggcctggagcctcccatcaccccgcttcttgttgggcctcaggcactggttaccagaagggggtctgggtctgctcaggatcatgttttgtagcacctcctgttggaggggtggagggatgttcccctgagccaggctgagactagaaccccatcttccctgagccaggctgagactagaaccccatcttccccaccacgccacccctgtggctgctacaggagcacagtagtgaaggcctgagctccaggtttgaaagacccaactggagcgtggggcgggcaggcaggggttagtgaaaggacacttccagggttaggacagagcatttagccttctggaagaacccctgcctggggtgggactgtgcaggccagagaaggtggcatgggcctgaacccacctggactgacttctgcactgaagccacagatggagggtaggctggtgggtgggggtggttcgttctctagccggggcagacacccagctggctgggtccttcctcagccttgcctcctcctgtccccaaccctttcctttcctcctgcttgcggactgctggtcccctctccttccctccttccagctgtttctagttaccacctacccctggccgtggactgatcagaccagcattcaaaataaaagtttgttccaagttg

SEQ ID NO: 744 - DNA, 3537 bp, Homo sapiens; identical to SEQ ID NO: 743

SEQ ID NO: 745 - DNA, 3373 bp, Homo sapiens
ggtggcaacttctcctcctgcggccgggagcggcctgcctgcctccctgcgcacccgcagcctcccccgctgcctccctagggctcccctccggccgccagcgcccatttttcattccctagatagagatactttgcgcgcacacacatacatacgcgcgcaaaaaggaaaaaaaaaaaaaaaagcccaccctccagcctcgctgcaaagagaaaaccggagcagccgcagctcgcagctcgcagctcgcagcccgcagcccgcagaggacgcccagagcggcgagcaggcgggcagacggaccgacggactcgcgccgcgtccacctgtcggccgggcccagccgagcgcgcagcgggcacgccgcgcgcgcggagcagccgtgcccgccgcccgggcccgccgccagggcgcacacgctcccgcccccctacccggcccgggcgggagtttgcacctctccctgcccgggtgctcgagctgccgttgcaaagccaactttggaaaaagttttttgggggagacttgggccttgaggtgcccagctccgcgctttccgattttgggggcctttccagaaaatgttgcaaaaaagctaagccggcgggcagaggaaaacgcctgtagccggcgagtgaagacgaaccatcgactgccgtgttccttttcctcttggaggttggagtcccctgggcgcccccacacggctagacgcctcggctggttcgcgacgcagccccccggccgtggatgctgcactcgggctcgggatccgcccaggtagccggcctcggacccaggtcctgcgcccaggtcctcccctgccccccagcgacggagccggggccgggggcggcggcgccgggggcatgcgggtgagccgcggctgcagaggcctgagcgcctgatcgccgcggacctgagccgagcccacccccctccccagccccccaccctggccgcgggggcggcgcgctcgatctacgcgtccggggccccgcggggccgggcccggagtcggcatgaatcgctgctgggcgctcttcctgtctctctgctgctacctgcgtctggtcagcgccgagggggaccccattcccgaggagctttatgagatgctgagtgaccactcgatccgctcctttgatgatctccaacgcctgctgcacggagaccccggagaggaagatggggccgagttggacctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaaggccacggtgacgctggaagaccacctggcatgcaagtgtgagacagtggcagctgcacggcctgtgacccgaagcccggggggttcccaggagcagcgagccaaaacgccccaaactcgggtgaccattcggacggtgcgagtccgccggccccccaagggcaagcaccggaaattcaagcacacgcatgacaagacggcactgaaggagacccttggagcctaggggcatcggcaggagagtgtgtgggcagggttatttaatatggtatttgctgtattgcccccatggggtccttggagtgataatattgtttccctcgtccgtctgtctcgatgcctgattcggacggccaatggtgcttcccccacccctccacgtgtccgtccacccttccatcagcgggtctcctcccagcggcctccggtcttgcccagcagctcaaagaagaaaaagaaggactgaactccatcgccatcttcttcccttaactccaagaacttgggataagagtgtgagagagactgatggggtcgctctttgggggaaacgggttccttcccctgcacctggcctgggccacacctgagcgctgtggactgtcctgaggagccctgaggacctctcagcatagcctgcctgatccctgaacccctggccagctctgaggggaggcacctccaggcaggccaggctgcctcggactccatggctaagaccacagacgggcacacagactggagaaaacccctcccacggtgcccaaacaccagtcacctcgtctccctggtgcctctgtgcacagtggcttcttttcgttttcgttttgaagacgtggactcctcttggtgggtgtggccagcacaccaagtggctgggtgccctctcaggtgggttagagatggagtttgctgttgaggtggtgtagatggtgacctgggtatcccctgcctcctgccaccccttcctccccatactccactctgattcacctcttcctctggttcctttcatctctctacctccaccctgcattttcctcttgtcctggcccttcagtctgctccaccaaggggctcttgaaccccttattaaggccccagatgaccccagtcactcctctctagggcagaagactagaggccagggcagcaagggacctgctcatcatattccaacccagccacgactgccatgtaaggttgtgcagggtgtgtactgcacaaggacattgtatgcagggagcactgttcacatcatagataaagctgatttgtatatttattatgacaatttctggcagatgtaggtaaagaggaaaaggatccttttcctaattcacacaaagactccttgtggactggctgtgcccctgatgcagcctgtggctggagtggccaaataggagggagactgtggtaggggcagggaggcaacactgctgtccacatgacctccatttcccaaagtcctctgctccagcaactgcccttccaggtgggtgtgggacacctgggagaaggtctccaagggagggtgcagccctcttgcccgcacccctccctgcttgcacacttccccatctttgatccttctgagctccacctctggtggctcctcctaggaaaccagctcgtgggctgggaatgggggagagaagggaaaagatccccaagaccccctggggtgggatctgagctcccacctcccttcccacctactgcactttcccccttcccgccttccaaaacctgcttccttcagtttgtaaagtcggtgattatatttttgggggctttccttttattttttaaatgtaaaatttatttatattccgtatttaaagttgt

SEQ ID NO: 746 - DNA, 2378 bp, Homo sapiens
gtgtgtgtgtgtgtgcgcgcgcatctgagagagagagagagagagagagactgactgagcaggaatggtgagatgtttatcatgggcctcggggaccccattcccgaggagctttatgagatgctgagtgaccactcgatccgctcctttgatgatctccaacgcctgctgcacggagaccccggagaggaagatggggccgagttggacctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaaggccacggtgacgctggaagaccacctggcatgcaagtgtgagacagtggcagctgcacggcctgtgacccgaagcccggggggttcccaggagcagcgagccaaaacgccccaaactcgggtgaccattcggacggtgcgagtccgccggccccccaagggcaagcaccggaaattcaagcacacgcatgacaagacggcactgaaggagacccttggagcctaggggcatcggcaggagagtgtgtgggcagggttatttaatatggtatttgctgtattgcccccatggggtccttggagtgataatattgtttccctcgtccgtctgtctcgatgcctgattcggacggccaatggtgcttcccccacccctccacgtgtccgtccacccttccatcagcgggtctcctcccagcggcctccggtcttgcccagcagctcaaagaagaaaaagaaggactgaactccatcgccatcttcttcccttaactccaagaacttgggataagagtgtgagagagactgatggggtcgctctttgggggaaacgggttccttcccctgcacctggcctgggccacacctgagcgctgtggactgtcctgaggagccctgaggacctctcagcatagcctgcctgatccctgaacccctggccagctctgaggggaggcacctccaggcaggccaggctgcctcggactccatggctaagaccacagacgggcacacagactggagaaaacccctcccacggtgcccaaacaccagtcacctcgtctccctggtgcctctgtgcacagtggcttcttttcgttttcgttttgaagacgtggactcctcttggtgggtgtggccagcacaccaagtggctgggtgccctctcaggtgggttagagatggagtttgctgttgaggtggtgtagatggtgacctgggtatcccctgcctcctgccaccccttcctccccatactccactctgattcacctcttcctctggttcctttcatctctctacctccaccctgcattttcctcttgtcctggcccttcagtctgctccaccaaggggctcttgaaccccttattaaggccccagatgaccccagtcactcctctctagggcagaagactagaggccagggcagcaagggacctgctcatcatattccaacccagccacgactgccatgtaaggttgtgcagggtgtgtactgcacaaggacattgtatgcagggagcactgttcacatcatagataaagctgatttgtatatttattatgacaatttctggcagatgtaggtaaagaggaaaaggatccttttcctaattcacacaaagactccttgtggactggctgtgcccctgatgcagcctgtggctggagtggccaaataggagggagactgtggtaggggcagggaggcaacactgctgtccacatgacctccatttcccaaagtcctctgctccagcaactgcccttccaggtgggtgtgggacacctgggagaaggtctccaagggagggtgcagccctcttgcccgcacccctccctgcttgcacacttccccatctttgatccttctgagctccacctctggtggctcctcctaggaaaccagctcgtgggctgggaatgggggagagaagggaaaagatccccaagaccccctggggtgggatctgagctcccacctcccttcccacctactgcactttcccccttcccgccttccaaaacctgcttccttcagtttgtaaagtcggtgattatatttttgggggctttccttttattttttaaatgtaaaatttatttatattccgtatttaaagttgt

SEQ ID NO: 747 - DNA, 3096 bp, Homo sapiens
gcccgcagggttcctccaagatggcggcgcagaggaggagcttgctgcagagtgagcagcagccaagctggacagatgacctgcctctctgccacctctctggggttggctcagcctccaaccgcagctactctgctgatggcaagggcactgagagccacccgccagaggacagctggctcaagttcaggagtgagaacaactgcttcctgtatggggtcttcaacggctatgatggcaaccgagtgaccaacttcgtggcccagcggctgtccgcagagctcctgctgggccagctgaatgccgagcacgccgaggccgatgtgcggcgtgtgctgctgcaggccttcgatgtggtggagaggagcttcctggagtccattgacgacgccttggctgagaaggcaagcctccagtcgcaattgccagagggagtccctcagcaccagctgcctcctcagtatcagaagatccttgagagactcaagacgttagagagggaaatttcgggaggggccatggccgttgtggcggtccttctcaacaacaagctctacgtcgccaatgtcggtacaaaccgtgcacttttatgcaaatcgacagtggatgggttgcaggtgacacagctgaacgtggaccacaccacagagaacgaggatgagctcttccgtctttcgcagctgggcttggatgctggaaagatcaagcaggtggggatcatctgtgggcaggagagcacccggcggatcggggattacaaggttaaatatggctacacggacattgaccttctcagcgctgccaagtccaaaccaatcatcgcagagccagaaatccatggggcacagccgctggatggggtgacgggcttcttggtgctgatgtcggaggggttgtacaaggccctagaggcagcccatgggcctgggcaggccaaccaggagattgctgcgatgattgacactgagtttgccaagcagacctccctggacgcagtggcccaggccgtcgtggaccgggtgaagcgcatccacagcgacaccttcgccagtggtggggagcgtgccaggttctgcccccggcacgaggacatgaccctgctagtgaggaactttggctacccgctgggcgaaatgagccagcccacaccgagcccagccccagctgcaggaggacgagtgtaccctgtgtctgtgccatactccagcgcccagagcaccagcaagaccagcgtgaccctctcccttgtcatgccctcccagggccagatggtcaacggggctcacagtgcttccaccctggacgaagccacccccaccctcaccaaccaaagcccgaccttaaccctgcagtccaccaacacgcacacgcagagcagcagctccagctctgacggaggcctcttccgctcccggcccgcccactcgctcccgcctggcgaggacggtcgtgttgagccctatgtggactttgctgagttttaccgcctctggagcgtggaccatggcgagcagagcgtggtgacagcaccgtagggcagccggaggaatgcagcccaagcagggcctggcatggggcaggacagggtccagccttttcctaacatctgcctgtgccacaacggccagcaggtgccccatcctctgcccacagcagactctgtcccatggctctccgggcagtagagtgtgtgagtgcagactggacctgtggttcataccttgtcaccacccgggaagctgaaggccacttcctcccagatggcctcagccaggaccatcgccctttctcagagcagagggccaggtagggaaaccgcagtgggcctgcaagccgcccgagcctccccagcagcctcctacagagcaggaagaggcgccctgtgaaccctgtagtgttgcaggcccagcagaccctgctgtcccaagcccacccctcctcccaccatcacctccctcacctcgggacagtagccctccacttctccagcctctcagccctgtgctcctgtatccagagtggaacccaggctggtgtccgtatctgtccctgggccccacccctggacctgccttggttgtgtcatctgttgtaaacattccaggaggaccaggggagcatctggggcctgggatggccacagaaggggcaggccaggtggaaaggagccagggggaagtggtctaagagacctggaactgccagaggatggcggcctgggcttccccagagccaggcgtgcgggagaggtgaggactggccccggtgggctgaggcaggggccgctgtcgtcaggcctgagccagggtgagctggtgcctgccttgcttcttccttctggtgctgtgaagaccataggctggcaggcagctgagatgaactgtctttaccactgatgaggggcctctgccggctgagggtagcaagcaggggttgtgagtcaggctgggggacttgtttgaaagaaagaggagttggaatgtggttcccaggagggaagaggttcctttgagacacagtaaccctgggaggcataggagaagggtcgggccagcccagcccagggcctgagttagactatttcccacatgttctctgccttcagtggggagggggtgccaccagggctgtcggccaggattgccactcctgtttcagaggaagcaggccgagagacttgcaccttggacaagccacacaatcagtggggcagccagagctcagacctgagccattgtgtcagtatccaggaccccccggattctccacgccctccccatctcccagtctccctgccccccatgccccagaccggcccaccagggactagccgctgtcgcacagcctctggggtgcttggtctctgcaaagtcaaaggcctgacagctctgtggcctgggaatccattttcctgcgggagagcagggcctggtgtggaaccagggagctgtgggaagccacagcagaaatggaagaaaaacaggtctcagcccagggtcctcgctcactccctcactccccactttgaagccatctctgttctgcaggtgagaggatttaaagtcagtcacaaaggcttgggaacaaaaggaattc

SEQ ID NO: 748 - DNA, 1661 bp, Homo sapiens
  misc_feature 1631, 1637: n = A,T,C or G
ccgcagggttcctccaagatggcggcgcagaggaggagcttgctgcagagtgagcagcagccaagctggacagatgacctgcctctctgccacctctctggggttggctcagcctccaaccgcagctactctgctgatggcaagggcactgagagccacccgccagaggacagctggctcaagttcaggagtgagaacaactgcttcctgtatggggtcttcaacggctatgatggcaaccgagtgaccaacttcgtggcccagcggctgtccgcagagctcctgctgggccagctgaatgccgagcacgccgaggccgatgtgcggcgtgtgctgctgcaggccttcgatgtggtggagaggagcttcctggagtccattgacgacgccttggctgagaaggcaagcctccagtcgcaattgccagagggagtccctcagcaccagctgcctcctcagtatcagaagatccttgagagactcaagacgttagagagggaaatttcgggaggggccatggccgttgtggcggtccttctcaacaacaagctctacgtcgccaatgtcggtacaaaccgtgcacttttatgcaaatcgacagtggatgggttgcaggtgacacagctgaacgtggaccacaccacagagaacgaggatgagctcttccgtctttcgcagctgggcttggatgctggaaagatcaagcaggtggggatcatctgtgggcaggagagcacccggcggatcggggattacaaggttaaatatggctacacggacattgaccttctcagcgctgccaagtccaaaccaatcatcgcagagccagaaatccatggggcacagccgctggatggggtgacgggcttcttggtgctgatgtcggaggggttgtacaaggccctagaggcagcccatgggcctgggcaggccaaccaggagattgctgcgatgattgacactgagtttgccaagcagacctccctggacgcagtggcccaggccgtcgtggaccgggtgaagcgcatccacagcgacaccttcgccagtggtggggagcgtgccaggttctgcccccggcacgaggacatgaccctgctagtgaggaactttggctacccgctgggcgaaatgagccagcccacaccgagcccagccccagctgcaggaggacgagtgtaccctgtgtctgtgccatactccagcgcccagagcaccagcaagaccagcgtgaccctctcccttgtcatgccctcccagggccagatggtcaacggggctcacagtgcttccaccctggacgaagccacccccaccctcaccaaagacccttccaggcctgcaagcgatttgacagccatccctcagtgccaactaaacctcctgggcagcctgaccccagggtaggaaggaagcgcctacaccaaggggccctctgggagctgagatcatcctggggttttgtcgcctggtctgacttgtgcactgggatcttctcgtgccaggccaggccccgccccctccccgggactgggcagaccccctccctcatgcatctgtgtccactgaggcttccctcacctagaatggcccatccttcaggacccagctcactctcatcttctttccanggaatntatccccgagggcggtcctcggtg

SEQ ID NO: 749 - DNA, 2327 bp, Homo sapiens
gagcggccgcgccgggtccccgggacggggtggaagtgggggtggggggaggggatcggggccgggccggggccgcgctgcctgcgatgccgggcgcccgccgcagccgctgccgccggagcccgggatggggcgagaggctgcggcggacgccagcatctccccgccggggaccccgggggccgcggagccgccgccgccgctgctgccgccgttgctgagacccagcgggcgatggggatgaagatgagacgctacaagctctttctcatgttctgtatggccggcctgtgcctcatctccttcctgcacttcttcaagaccctgtcctatgtcaccttcccccgagaactggcctccctcagccctaacctggtgtccagctttttctggaacaatgccccggtcacgccccaggccagccccgagccaggaggccctgacctgctgcgtaccccactctactcccactcgcccctgctgcagccgctgccgcccagcaaggcggccgaggagctccaccgggtggacttggtgctgcccgaggacaccaccgagtatttcgtgcgcaccaaggccggcggcgtctgcttcaaacccggcaccaagatgctggagaggccgcccccgggacggccggaggagaagcctgagggggccaacggctcctcggcccggcggccaccccggtacctcctgagcgcccgggagcgcacggggggccgaggcgcccggcgcaagtgggtggagtgcgtgtgcctgcccggctggcacggacccagctgcggcgtgcccactgtggtgcagtactccaacctgcccaccaaggagcggctggtgcccagggaggtgccgcgccgcgtcatcaacgccatcaacgtcaaccacgagttcgacctgctggacgtgcgcttccacgagctgggcgacgtggtggacgcctttgtggtgtgcgagtccaacttcacggcttatggggagccgcggccgctcaagttccgggagatgctgaccaatggcaccttcgagtacatccgccacaaggtgctctatgtcttcctggaccacttcccgcccggcggccggcaggacggctggatcgccgacgactacctgcgcaccttcctcacccaggacggcgtctcgcggctgcgcaacctgcggcccgacgacgtcttcatcattgacgatgcggacgagatcccggcccgtgacggcgtccttttcctcaagctctacgatggctggaccgagcccttcgccttccacatgcgcaagtcgctctacggcttcttctggaagcagccgggcaccctggaggtggtgtcaggctgcacggtggacatgctgcaggcagtgtatgggctggacggcatccgcctgcgccgccgccagtactacaccatgcccaacttcagacagtatgagaaccgcaccggccacatcctggtgcagtggtcgctgggcagccccctgcacttcgccggctggcactgctcctggtgcttcacgcccgagggcatctacttcaagctcgtgtccgcccagaatggcgacttcccacgctggggtgactacgaggacaagcgggacctgaactacatccgcggcctgatccgcaccgggggctggttcgacggcacgcagcaggagtacccgcctgcagaccccagcgagcacatgtatgcgcccaagtacctgctgaagaactacgaccggttccactacctgctggacaacccctaccaggagcccaggagcacggcggcgggcgggtggcgccacaggggtcccgagggaaggccgcccgcccggggcaaactggacgaggcggaagtctagagctgcatgatctgatagggtttgtgacagggcgggggtggcggcggcccctagcgctatctccctgcctcctgccggctccttggttcttgaggggaccaggagtgggtggggagtgggggtgggggtagggtttccctactgaagcccttgtgaatcaagggtcaggcctttgagctcagaaaatatccctcctgttgggagagggcgcaggccgtgacgtctgggtggcccttatgactgccaagactgctgtggccaggaggtgccactggagtgtgcgtggtggtccctgggtagcgggggagggtaggcaggattggggaagagagcctgcaggatctcaccaggcagcctctggggggtggccaggccgggaaaaagcccaccatttggcatccctgggccttgggctccgtgtgggagaccggcctgccaggaggacccagggctctgtaagtagatgcatttgggtccaggaggaa

SEQ ID NO: 750 - DNA, 5730 bp, Homo sapiens
cctccgcctccactcgccctcgtgctcccttcagccccttcgcagctccgtgcgcaaggtcgtgtcccggaagtgaaggggccatgttgatgggtgacccggggagaggtacccggccagaggcgagtcctgcggagtggtagcgcgcacggcctgcggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacagatacattctgcccgccccggcccaagccagtggccaggaagggccaggtagacttgaagaagtcacgactccgcatgtccctgcaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgacttcctgccatcagtgaccctcggtgacacagtcttggtggccaaaccacaccggctagcccagtatgacaacctgtggcggctgagcctgcgtcccgcggagacggcacgcctgcgggctctggaccaggctgactcgggctgccgatctctgtgcctcaagatcctcaaggccatatgcaagtccaccccggctctgggccacctcactgccagccagctaaccaatgtcatcctccacttggcccaggaggaggctgactggtctccggatatgctggccgaccgtttcctgcaggccttgaggggacttatcagctacttagaggctggagtcctgcccagtgccctaaaccccaaggtgaacttatttgcagagctcacccctgaagaaatagacgaattaggatacactctgtattgctcattgtctgagccagaggtgctgctgcagacgtagggcaggtgaaggccaaagcgggtgttggtggtcaggccctggattctccgttagatacacttggctacctagttggtgcctcacagggttcctgctgcctggtgtcttgctgatcatcaccctggtcacttcatgctgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctgagacagtatttagggtttctgggagtgaggctggtagaagagttggcctttgaccacggttcctggagtagaagtccatcctccccccaacctcctgacccattcataaatgctgagaatgtctctcatgggaacactgttaatgacccacacaggataagctgaatgcaaagttatttgcaggttgaatttcttggtggctattagcagaagtgcagagtagggaaccagagctggttaagggcctagtgaagggtttgtgtgcccagtgtctgctcgtcatctgtggctgcaggggtcagacagacaaggatggggactgccagggcaccacttcatcatgaatgctggttttcacaccttttccttattttattgccaatcaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaaaaaaaatctgtatgcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaagcttgcatctctgaccaaatttcacataaaacattggaaggaggctgggtgcggtggctcatgcttgtaatcccagcactgggaagctaaggcgggtggatcacttgaggtcaggagttcgagaccagcctggccaacatggtgaaaccccgtctccacgaaaaagataaaaataagctgggcgtggtggcaggcgcctataatcccagctactcgggaggctgaggcaggagaataacttaaacccgggaggcggaggttacagtgagctgagatcgtgccactgcactccagcctgggtgacagagtgagaccctatttcaaaaaaataaaaattggaagaagagcttaaaaaagataagattttaaagagtcccaagttatttaagttgagtgtaattgtcatttaaggaaggcaaatgagtttatcatccttcttaaagagcatctcttttaactgttggacaaaaccataactttgtcattttacaaggaagaacctcttaagaagtcctcagaaccagaagcaatgtgaactctcagcgctggtcctggtgggtttgctgaccatgactgggcaagccgttctttttgctgccatcttcctcatcataaagtgtggaacataggcaattgctttgagattcttggatagaagaggacaacattctgcacctgcccccttttttaaatctttggggaaagatgagtaactttccccactactctgccttcctgttcagtaactcttacttttgcctgaagtaacagcatcttctacttctccatctagagatttttgtgtgtgtgccatcaaggttagcaaactttatacgtagcctaacacttaaaaaatgcactcattatcttaaacctaataaattccagagtttattttggttctcctctgttgcccttcctaaaaaatgagctgaagatgacagtatttttctttacatgcttggttatgacttttaaagttttatttaaataaatgttgaagctcaagtttaaagaagcgttgcagaggcccacggtctcctgggtcccggccacctgtccatattccacatttgctgactgtgctccctgcactccactcaagttgagagttcaaatagtcttgaaggggaatcagcttcaggatggaaggacccaggagaggccccgaggtgggagggttctgtaaatacagactactgcgagtgtccagagctctctgccatgatacttccttgggactgacttggctgagaacgtgttctgtcagaggatttgttagaactctgcccttttgtctgaaactcaaggccaaggagaatgataggagacttaggacagagctgacccttgcaccaggctgggaggctgcagcccttttagatgccacttactgtaagtggccagaataccagagaggtgggttccatggtcaaatgcacagtaggtgtttacctttacatttggatcaccttgtagtctttaaattcttggtccctgaggccaagtccacaacttgccttctagtcacttgcctgcccgcagtggtggtggatgtgttagctggtagatttggaatcagtcaccagtctttctgtactgtcttggttagctctatataagtaggggcagcttagccctgaggcccagagacctgctgtcctttttctccttgagggaggaaataaaactgcggaatacaatgtccttccatagcatgggaagaagaaaataaacatctcctttccaacaaaaaaaaaaaaaaaaaaaaaaaaaaaaaaaa

SEQ ID NO: 751 - DNA, 5730 bp, Homo sapiens; identical to SEQ ID NO: 750

SEQ ID NO: 752 - DNA, 2022 bp, Homo sapiens
tttctactttgcccgcccacagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgtgagtaccggggcgggtcgtccagctgtgctcctggggccggcgcgggttttggattggtggggtgcggcctggggccagggcggtgccgccaagggggaagcgatttaacgagcgcccgggacgcgtggtctttgcttgggtgtccccgagacgctcgcgtgcctgggatcgggaaagcgtagtcgggtgcccggactgcttccccaggagccctacagccctcggaccccgagccccgcaagggtcccaggggtcttggctgttgccccacgaaacgtggcaggaaccaagatggcggcggcagggcggcggcgcgggcgtgagtcaagggcgggcggtgggcggggcgcggccgccctggccgtatttggacgtggggacggagcgctttcctcttggcggccggtggaagaatcccctggtctccgtgagcgtccattttgtggaacctgagttgcaagcagggaggggcaaatacaactgccctgttcccgattctctagatggccgatctagagaagtcccgcctcataagtggaaggatgaaattctcagaacagctaacctctaatgggagttggcttctgattctcattcaggcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaagta

SEQ ID NO: 753 - DNA, 1420 bp, Homo sapiens
tttctactttgcccgcccacagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaagta

SEQ ID NO: 754 - DNA, 2327 bp, Homo sapiens; identical to SEQ ID NO: 749

SEQ ID NO: 755 - DNA, 2825 bp, Homo sapiens
tggggaagctgctaacccgacccggattggcgctgaggtggcccgtggggcagggcagatgattctggaccagatgaagcctgaggagccttccagctctaagatagcaggataggagacttctaagattggagctgcagaagacttgccagcccaccagcacaatgtcaggaagccatacacctgcctgtggccctttctcagccctgactccgagcatatggccccaggagatcttggccaagtacacgcagaaggaagagtcagcagagcaaccagagttctactacgatgagtttggtttccgtgtgtacaaggaagaaggtgatgagcctggctccagtctgctggcgaactcccctctgatggaggatgctccacagaggctgcggtggcaggcccacctggagttcacccataaccacgatgtgggggatctcacctgggacaagattgccgtctccctaccccgctctgagaagctccgctccctggtgctggccggcatcccacatggcatgaggccacagctgtggatgcggctctctggggccctgcagaagaagaggaactctgagctgtcctaccgcgagattgtgaagaacagctccaacgatgagaccatcgctgccaagcagatcgagaaggacctgctccgcaccatgcccagcaacgcctgcttcgccagcatgggtagcatcggggtgccccgcctgcgcagggtgctccgggccctggcctggctctacccagagatcggctactgccagggcaccggcatggtggccgcctgcctcctgctgttcctggaggaggaggacgccttctggatgatgtctgccatcatcgaggacctgctccccgcctcctacttcagcaccaccctgctgggtgtccagactgaccagcgggtcctgcgccacctcattgtccagtacctgcctcgcctggacaagctgctccaggagcatgacattgagctgtccctgatcacactgcactggttcctcacggccttcgccagcgtggtggacatcaagctgctcctgcgcatctgggacctgtttttctacgagggctcccgggtgctgttccagctcacgctgggcatgctgcacctcaaggaggaagagctgatccagtcagagaactcggcctccatcttcaacacgctatcggatatcccgtcgcagatggaggacgcggagctgcttctgggggtggccatgcggctggccggctccctcaccgatgtggccgtggagactcagcgccgcaagcacctggcctatctcattgcagaccagggccagctcctgggggccggcaccctcaccaacctctctcaggttgttcgccgcaggacccagcggaggaagtccaccatcactgctctgctcttcggggaggatgacctggaggcactcaaggccaagaacatcaagcagacggaactggtggctgacctccgggaagccatcctgcgcgtggcacgccacttccagtgcacagaccccaaaaactgcagcgtggagctgactccagactatagcatggagagccaccagcgggaccacgagaactacgtggcgtgctcacgcagccaccggcgccgagccaaggccctgctggactttgagcggcacgacgacgacgagctgggcttccgcaagaacgacatcatcacaatcgtgtctcagaaggacgagcactgctgggtgggggagctcaacggcctgcgaggctggtttccagccaagttcgtggaagtcctggatgagcgcagcaaagagtactccatcgcgggggatgactcggtgacggagggggtcacagacctcgtgcgagggaccctctgcccggcccttaaggccctgttcgaacatggactgaagaagccatccctgcttgggggcgcctgccacccctggctgtttatcgaggaggctgcaggccgggaggtcgagagagactttgcctccgtgtattcccgtctggtgctctgtaagaccttcaggttggatgaagatggcaaagtcctgaccccggaggagctgctctaccgggctgtgcagtctgtgaacgtgacccacgatgcagtgcatgcacaaatggatgtgaagctccgctcactgatctgcgtggggctcaatgagcaggtgctgcacctgtggctggaggtgctctgctccagcctgcccaccgtggagaagtggtaccagccctggtccttcctgcgcagcccgggctgggtccagatcaagtgtgagctccgagtcctctgctgctttgccttcagcctctcccaggactgggagctccctgcgaagagagaggcgcagcagcccctgaaggagggcgtccgggacatgctggtgaagcaccacctcttcagctgggatgtggacgggtgaccccctcctccccagcccaacctcgggcctgcgtctgaggtggcccaggaccccaagctgcagagcccagggaagagcagctccagagccctggccggggccgcgggatatcaatatcaggctgccccactccacgttccccagcacatcccaggtggtgggagcagagggtaccctgccccaccagggtccttagggatgctctaggccaaaccacagtttgtaccaaaaaccttgtgaggaggtgggggagccatgtctgtgctcaggaagagggaaggggatgggggtggctagtaggctcctggcctctttggtttataaataaactgtgtctgtctttgaaaaaaaaaaaaaaaaaaaaaaaaaaaaaaaaaaaaaaaaaaaaaaaaaaaaaaaaaaaaaaaaaaa

SEQ ID NO: 756 - protein, 1162 aa, Homo sapiens
MEEVRCPEHGTFCFLKTGVRDGPNKGKSFYVCRADTCSFVRATDIPVSHCLLHEDFVVELQGLLLPQDKKEYRLFFRCIRSKAEGKRWCGSIPWQDPDSKEHSVSNKSQHASETFHHSSNWLRNPFKVLDKNQEPALWKQLIKGEGEEKKADKKQREKGDQLFDQKKEQKPEMMEKDLSSGLVPKKKQSVVQEKKQEEGAEIQCEAETGGTHKRDFSEIKSQQCQGNELTRPSASSQEKSSGKSQDVQRESEPLREKVTQLLPQNVHSHNSISKPQKGGPLNKEYTNWEAKETKAKDGPSIQATQKSLPQGHFQERPETHSVPAPGGPAAQAAPAAPGLSLGEGREAATSSDDEEEDDVVFVSSKPGSPLLFDSTLDLETKENLQFPDRSVQRKVSPASGVSKKVEPSDPVARRVYLTTQLKQKKSTLASVNIQALPDKGQKLIKQIQELEEVLSGLTLSPEQGTNEKSNSQVPQQSHFTKTTTGPPHLVPPQPLPRRGTQPVGSLELKSACQVTAGGSSQCYRGHTNQDHVHAVWKITSEAIGQLHRSLESCPGETVVAEDPAGLKVPLLLHQKQALAWLLWRESQKPQGGILADDMGLGKTLTMIALILTQKNQEKKEEKEKSTALTWLSKDDSCDFTSHGTLIICPASLIHHWKNEVEKRVNSNKLRVYLYHGPNRDSRARVLSTYDIVITTYSLVAKEIPTNKQEAEIPGANLNVEGTSTPLLRIAWARIILDEAHNVKNPRVQTSIAVCKLQACARWAVTGTPIQNNLLDMYSLLKFLRCSPFDEFNLWRSQVDNGSKKGGERLSILTKSLLLRRTKDQLDSTGRPLVILPQRKFQLHHLKLSEDEETVYNVFFARSRSALQSYLKRHESRGNQSGRSPNNPFSRVALEFGSEEPRHSEAADSPRSSTVHILSQLLRLRQCCCHLSLLKSALDPMELKGEGLVLSLEEQLSALTLSELRDSEPSSTVSLNGTFFKMELFEGMRESTKISSLLAELEAIQRNSASQKSVIVSQWTNMLKVVALHLKKHGLTYATIDGSVNPKQRMDLVEAFNHSRGPQVMLISLLAGGVGLNLTGGNHLFLLDMHWNPSLEDQACDRIYRVGQQKDVVIHRFVCEGTVEEKILQLQEKKKDLAKQVLSGSGESVTKLTLADLRVLFGI

SEQ ID NO: 757 - protein, 943 aa, Homo sapiens
MGLTKQYLRYVASAVFGVIGSQKGNIVFVTLRGEKGRYVAVPACEHVFIWDLRKGEKILILQGLKQEVTCLCPSPDGLHLAVGYEDGSIRIFSLLSGEGNVTFNGHKAAITTLKYDQLGGRLASGSKDTDIIVWDVINESGLYRLKGHKDAITQALFLREKNLLVTSGKDTMVKWWDLDTQHCFKTMVGHRTEVWGLVLLSEEKRLITGASDSELRVWDIAYLQEIEDPEEPDPKKIKGSSPGIQDTLEAEDGAFETDEAPEDRILSCRKAGSIMREGRDRVVNLAVDKTGRILACHGTDSVLELFCILSKKEIQKKMDKKMKKARKKAKLHSSKGEEEDPEVNVEMSLQDEIQRVTNIKTSAKIKSFDLIHSPHGELKAVFLLQNNLVELYSLNPSLPTPQPVRTSRITIGGHRSDVRTLSFSSDNIAVLSAAADSIKIWNRSTLQCIRTMTCEYALCSFFVPGDRQVVIGTKTGKLQLYDLASGNLLETIDAHDGALWSMSLSPDQRGFVTGGADKSVKFWDFELVKDENSTQKRLSVKQTRTLQLDEDVLCVSYSPNQKLLAVSLLDCTVKIFYVDTLKFFLSLYGHKLPVICMDISHDGALIATGSADRNVKIWGLDFGDCHKSLFAHDDSVMYLQFVPKSHLFFTAGKDHKIKQWDADKFEHIQTLEGHHQEIWCLAVSPSGDYVVSSSHDKSLRLWERTREPLILEEEREMEREAEYEESVAKEDQPAVPGETQGDSYFTGKKTIETVKAAERIMEAIELYREETAKMKEHKAICKAAGKEVPLPSNPILMAYGSISPSAYVLEIFKGIKSSELEESLLVLPFSYVPDILKLFNEFIQLGSDVELICRCLFFLLRIHFGQITSNQMLVPVIEKLRETTISKVSQVRDVIGFNMAGLDYLKRECEAKSEVMFFADATSHLEEKKRKRKKREKLILTLT

SEQ ID NO: 758 - protein, 664 aa, Homo sapiens
MSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQGGINAALGNMEEDNWRWHFYDTVKGSDWLGDQDAIHYMTEQAPAAVVELENYGMPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATGGYGRTYFSCTSAHTSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSFVDVGTGKVTLEYRPVIDKTLNEADCATIPPAIRSY

SEQ ID NO: 759 - protein, 191 aa, Homo sapiens
MAAYSYRPGPGAGPGPAAGAALPDQSFLWNVFQRVDKDRSGVISDTELQQALSNGTWTPFNPVTVRSIISMFDRENKAGVNFSEFTGVWKYITDWQNVFRTYDRDNSGMIDKNELKQALSGFGYRLSDQFHDILIRKFDRQGRGQIAFDDFIQGCIVLQRLTDIFRRYDTDQDGWIQVSYEQYLSMVFSIV

SEQ ID NO: 760 - protein, 745 aa, Homo sapiens
MKETDREAVATAVQRVAGMLQRPDQLDKVEQYRRREARKKASVEARLKAAIQSQLDGVRTGLSQLHNALNDVKDIQQSLADVSKDWRQSINTIESLKDVKDAVVQHSQLAAAVENLKNIFSVPEIVRETQDLIEQGALLQAHRKLMDLECSRDGLMYEQYRMDSGNTRDMTLIHGYFGSTQGLSDELAKQLWMVLQRSLVTVRRDPTLLVSVVRIIEREEKIDRRILDRKKQTGFVPPGRPKNWKEKMFTILERTVTTRIEGTQADTRESDKMWLVRHLEIIRKYVLDDLIVAKNLMVQCFPPHYEIFKNLLNMYHQALSTRMQDLASEDLEANEIVSLLTWVLNTYTSTEMMRNVELAPEVDVGTLEPLLSPHVVSELLDTYMSTLTSNIIAWLRKALETDKKDWVKETEPEADQDGYYQTTLPAIVFQMFEQNLQVAAQISEDLKTKVLVLCLQQMNSFLSRYKDEAQLYKEEHLRNRQHPHCYVQYMIAIINNCQTFKESIVSLKRKYLKNEVEEGVSPSQPSMDGILDAIAKEGCSGLLEEVFLDLEQHLNELMTKKWLLGSNAVDIICVTVEDYFNDFAKIKKPYKKRMTAEAHRRVVVEYLRAVMQKRISFRSPEERKEGAEKMVREAEQLRFLFRKLASGFGEDVDGYCDTIVAVAEVIKLTDPSLLYLEVSTLVSKYPDIRDDHIGALLAVRGDASRDMKQTIMETLEQGPAQASPSYVPLFKDIVVPSLNVAKLLK

SEQ ID NO: 761 - protein, 458 aa, Homo sapiens
MDADDEAVLNLIAECEWDLGRPPGSTSFSQKGREADSRGSQESRHLLSPQLVQYQCGDSGKQGRETRRSSCRGCCLEKMPWSQLCGELPPLYGAEPEASRAPRPHTYFTPHPDSMDTEDSASSQKLDLSGEMVPGPLPAPGKCRKRRMPVGRFQTFSDQEGLGCPERTHGSSVPKESLSRQDSSESRNGRTLSQPEASETEEQRSRGVTDTREPSPGSHSALPGKKTALQAALLETLLDLVDRSWGGCRSLHSNEAFLAQARHILSSVEEFTAAQDSSAMVGEDVGSLALESKSLQSRLAEQQQQHAREMSEVTAELHHTHKELDDLRQHLDKSLEENSRLKSLLLSMKKEVKSADTAATLNLQIAGLQTSVKRLCVEIVELKQHLEHYDKIQELTQMLQESHSSLVSTNEHLLQELSQVRAQHRAEVEQMHWSYQELKKTMALFPHSSASHGGCQAC

SEQ ID NO: 762 - protein, 233 aa, Homo sapiens
MKGYQSLVFNFFFLKLSAENESTPIQQLLDHFLRQLQRKDPHGFFAFPVTDAIAPGYSMIIKHPMDFGTMKDKIVANEYKSVTEFKADFKLMCDNAMTYNRPDTVYYKLAKKILHAGFKMMSKQAALLGNEDTAVEEPVPEVVPVQVETAKKSKKPSREVISCMFEPEGNACSLTDSTAEEHVLALVEHAADEARDRINRFLPGGKVVLCGHRERVPRGPRLSVCLSFWVGAV

SEQ ID NO: 763 - protein, 534 aa, Homo sapiens
MRLRGCGPRAAPASSAGASDARLLAPPGRNPFVHELRLSALQKAQVALMTLTLFPVRLLVAAAMMLLAWPLALVASLGSAEKEPEQPPALWRKVVDFLLKAIMRTMWFAGGFHRVAVKGRQALPTEAAILTLAPHSSYFDAIPVTMTMSSIVMKAESRDIPIWGTLIQYIRPVFVSRSDQDSRRKTVEEIKRRAQSNGKWPQIMIFPEGTCTNRTCLITFKPGAFIPGAPVQPVVLRYPNKLDTITWTWQGPGALEILWLTLCQFHNQVEIEFLPVYSPSEEEKRNPALYASNVRRVMAEALGVSVTDYTFEDCQLALAEGQLRLPADTCLLEFARLVRGLGLKPEKLEKDLDRYSERARMKGGEKIGIAEFAASLEVPVSDLLEDMFSLFDESGSGEVDLRECVVALSVVCRPARTLDTIQLAFKMYGAQEDGSVGEGDLSCILKTALGVAELTVTDLFRAIDQEEKGKITFADFHRFAEMYPAFAEEYLYPDQTHFESCAETSPAPIPNGFCADFSPENSDAGRKPVRKKLD

SEQ ID NO: 764 - protein, 124 aa, Homo sapiens
MAAAMTFCRLLNRCGEAARSLPLGARCFGVRVSPTGEKVTHTGQVYDDKDYRRIRFVGRQKEVNENFAIDLIAEQPVSEVETRVIACDGGGGALGHPKVYINLDKETKTGTCGYCGLQFRQHHH

SEQ ID NO: 765 - protein, 2244 aa, Homo sapiens
MGRQGGERFNQALGLAHGGRWRPHLGLGTRRSGITGCRGDRRGHMTEERKCLRQLWLGEPFASPTGTSVHGWTRPDLAGSGLAGGGPGGISRDRTGPTPRAPEAENSNLHHQVEEMLQKISPLQKCQEELGSLKAELEEKKSSLKLYQDTHQEYARVKEECLKSDAQKKKLEAKVKKLQGKVKLLLKELWLCVNTTHRLPGEGSRCVPEKPAKAITSSRVPGEDGTLPPTQGSPLRTSNVQTCLTKLSMEIKEDFLCQNVEKQSSSGTNCSSDHVFNENGNLEVLVQSHRDGGSTEFVDHDHFFDEDLQAAIDFFKLPPPLLSPVPSPPPMSSPHPGSLPSSFAPETYFGEYTDSSDNDSVQLRNSAECVSEDDTTESQNYFGSLRKNKGSGTWEEKPKSHEAIQALNTWEVNKVTTSGLETFTATLRESSATHSLVGEKHWTTASRSMSDRKRDILHETKTQMEVREMDKSVQTEKTIHKLTRGLCIERLSASPAQEKEAAPGKSELCSSPLGKRPLNELMESEGKTVLSKMMGSPKSEFTKWTRINEITSEPDRITVSGHFHRLSRELEKEKEDTQGFTLGESPESEDDDSGDGMDVAGLDIETSFSSSSTLVALSVGSNPQSSSGLDCGNDTDITTKVFSTEPHHSEHKLQTKTLNTLHLQSEPPECSIGGNNLENSLCALSPELGASNFNDQKSSGIEYTKVVKGLTKIHSLPRSVFMKATKDGQCESQDPRIELTLNKPDFTSLIGSQAALIKSGLGFVKSTSWHHSDLLRKGGEESLRAKSEHEQKTSHQLQKAMPFLQNRGPTPKPDLLRENNNPVEFKTTASVLPNQVSVITKQTRPEKVQSAKLEHLRPHRVEPTLVTENSGNKTGMSTVAKCDGERDDTTQNITEVAAVKSISPEVSASRRKLDFNSPGGSSPVENSDCSTNSRLSFSPENILIQNQDIVREAAVQGDGQKQRQPQATDLDSSGTHGSEMLPATEVTVSGGFSVEETSCGDTGRSGGEALAVANDSTSTPQNANGLWKLKSTTPGGALPECFGTTDTTFSSAFCRKHGETQDTSQSSLPGTLHCYTGIREGGDDTEVESEAFSCSEGSEQQDAPDDSQKNLGDTDAAVAEVRPSLEVGYLTSALQDFNISTFSELDRLSTSEVVMFLESCQLGDYSSGDSVSECSSKGTLSKEMNKELKASEIGEKYRKQPCEEETLGTCEEWIESEEDDYSLKNTSQLTQCSLETLSEVLTKIRQELQTNSEDCNGKDTGSLLLLNVNNNMTTENLKEKSPFRETTGSSSHASEPTPQAAALDTEGSSPISGMPQNENPQSRPEARSDAGRQTDGGEEDLPEPVEPSALCSDSVMEPSIEQSSNCEAETTFQCQIATVTSEVINVLINKDQNLVIEKGDNWTIISGVAVLPHVDQVTLCDIPGDIPISQDQGELEAGCIPVTSAEKSPEASHTGPAFQEAPCGNNLSCPQEDVSSSGQSTNFDKSRLRNRPVKPSIWISSQIYDQNFETQIVASDHTYYNSKLEPSGKNKNRSKISNKDQSNKPVKTSASSRVETHQSEVAQSFSGEKANTKTQRSQTQTILANADTSTPTDCSPDTLSKIRQEVGPPLPPLLAPLIATPPRTSQPLSPLISSSSPSSPASPVGQVSPFRETPVPPAMSPWPEDPRRASPPDPSPSPSAASASERVVPSPLQFCAATPKHALPVPGRLPPCASGHAAVGGPQENSVKILDTMYPELSARARTLNILKGNIQLTRGPPADCKNLPGPASAMIGFKTITSAATAFVKTGSSSGGDCNQDKSRDLGTQQDSSGKRTLSTSTLRSAKRLRLDTGSPEPETRGVTAEGIHKNLPGNLPPAEVATTNEERSCSSPAVSAVSQLPLSPKETVESHDKAIANALKKIAEFSFDLLPVIRSHVYVGNISKKPVMRDQEKEVVYEFSTTKKHLAECLLHSILSELKIQKISMDHNYIHALCRVYVGICRQLGDLERARLFCYSLLKEDFPESEKLTLFIANMWHDIFLSQSVINKAMQLVARQRAKGEVLNCLRAFLNWEKNAPVDVGFMVSKLLLTIQLCPKTEFQPSEKFGEDLSDNTWEYIFAIDLLCCHQKWIWTHDNIISKELWPVMDKWIKYRKGHANIAYTPDIIIASILRLIGRLGQLGLKEGFPSAVKNISSVIGMFIQHAHDEDIPWGIQLAAVYALCDLSPSNPAEISKILEAWRREASKSVPSAIVSCLEEVSALSTEELG

SEQ ID NO: 766 - protein, 4289 aa, Homo sapiens
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTEEREEESPPRPSLSQPPRRPWGNLTAELSRFRGTVQDLERHLRAHGYPLRANQTYTSVARHIHEYLQRQVLGSSADGALLVSLDGLRGQFERVVLRWRPQPPAEGPGGELTVPGTTRTVSLPDLRPGTTYHVEVHGVRAGQTSKSYAFITTTGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPHLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPEPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTEEETPSPTELSTEAREPPEEPLLGELTVTGSSPDSLSLSWTIPQGHFDSFTVQYKDRDGRPQVMRVRGEESEVTVGGLEPGRKYKMHLYGLHEGRRVGPVSTVGVTVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTAPKDEAETTQAVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 767 - protein, 673 aa, Homo sapiens
MRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 768 - protein, 278 aa, Homo sapiens [sequence omitted]

SEQ ID NO: 769 - protein, 51 aa, Homo sapiens
MPEPASRCLLLLPLLLLLLLLLPAPELGPSQAGAEENDWVRLPSKCEGTCG

SEQ ID NO: 770 - protein, 602 aa, Homo sapiens
MPYKLKKEKEPPKVAKCTAKPSSSGKDGGGENTEEAQPQPQPQPQPQAQSQPPSSNKRPSNSTPPPTQLSKIKYSGGPQIVKKERRQSSSRFNLSKNRELQKLPALKDSPTQEREELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQLAYCVVQFLEKESSLTEPVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 771 - protein, 570 aa, Homo sapiens
MPYKLKKEKEPPKVAKCTAKPSSSGKDGGGENTEEAQPQPQPQPQPQAQSQPPSSNKRPSNSTPPPTQLSKIKYSGGPQIVKKELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQLAYCVVQFLEKESSLTEPVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 772 - protein, 496 aa, Homo sapiens
MPYKLKKEKELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQLAYCVVQFLEKESSLTEPVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 773 - protein, 375 aa, Homo sapiens
MDVTSQARGVGLEMYPGTAQPAAPNTTSPELNLSHPLLGTALANGTGELSEHQQYVIGLFLSCLYTIFLFPIGFVGNILILVVNISFREKMTIPDLYFINLAVADLILVADSLIEVFNLHERYYDIAVLCTFMSLFLQVNMYSSVFFLTWMSFDRYIALARAMRCSLFRTKHHARLSCGLIWMASVSATLVPFTAVHLQHTDEACFCFADVREVQWLEVTLGFIVPFAIIGLCYSLIVRVLVRAHRHRGLRPRRQKALRMILAVVLVFFVCWLPENVFISVHLLQRTQPGAAPCKQSFRHAHPLTGHIVNLAAFSNSCLNPLIYSFLGETFRDKLRLYIEQKTNLPALNRFCHAALKAVIPDSTEQSDVRFSSAV

SEQ ID NO: 774 - protein, 375 aa, Homo sapiens; identical to SEQ ID NO: 773

SEQ ID NO: 775 - protein, 2394 aa, Homo sapiens
MWLSGKSQVQKRGAVRYLQAPPVNGEASACPAPPTHLDRTTCARRRPARLPPPWGAAGIRPAPRASRASFWARFPPHCFPSGCSGSRVLEGGEIGFRFRGGRVAAAALRSRWARGDAAAAGSREGRGRMNRAKPTTVRRPSAAAKPSGHPPPGDFIALGSKGQANESKTASTLLKPAPSGLPSERKRDAAAALSSASALTGLTKRPKLSSTPPLSALGRLAEAAVAEKRAISPSIKEPSVVPIEVLPTVLLDEIEAAELEGNDDRIEGVLCGAVKQLKVTRAKPDSTLYLSLMYLAKIKPNIFATEGVIEALCSLLRRDASINFKAKGNSLVSVLACNLLMAAYEEDENWPEIFVKVYIEDSLGERIWVDSPHCKTFVDNIQTAFNTRMPPRSVLLQGEAGRVAGDLGAGSSPHPSLTEEEDSQTELLIAEEKLSPEQEGQLMPRYEELAESVEEYVLDMLRDQLNRRQPIDNVSRNLLRLLTSTCGYKEVRLLAVQKLEMWLQNPKLTRPAQDLLMSVCMNCNTHGSEDMDVISHLIKIRLKPKVLLNHFMLCIRELLSAHKDNLGTTIKLVIFNELSSARNPNNMQVLYTALQHSSELAPKFLAMVFQDLLTNKDDYLRASRALLREIIKQTKHEINFQAFCLGLMQERKEPQYLEMEFKERFVVHITDVLAVSMMLGITAQVKEAGIAWDKGEKRNLEVLRSFQNQIAAIQRDAVWWLHTVVPSISKLAPKDYVHCLHKVLFTEQPETYYKWDNWPPESDRNFFLRLCSEVPILEDTLMRILVIGLSRELPLGPADAMELADHLVKRAAAVQADDVEVLKVGRTQLIDAVLNLCTYHHPENIQLPPGYQPPNLAISTLYWKAWPLLLVVAAFNPENIGLAAWEEYPTLKMLMEMVMTNNYSYPPCTLTDEETRTEMLNRELQTAQREKQEILAFEGHLAAASTKQTITESSSLLLSQLTSLDPQYAAHTAPPCACRRDLGPPRRPPPHILDQVKSLNQSLRLGHLLCRSRNPDFLLHIIQRQASSQSMPWLADLVQSSEGSLDVLPVQCLCEFLLHDAVDDAASGEEDDEGESKEQKAKKRQRQQKQRQLLGRLQDLLLGPKADEQTTCEVLDYFLRRLGSSQVASRVLAMKGETLPALPKAGPAHECLPQGLSLVLSEGSLRDGEEKEPPMEEDVGDTDVLQGYQWLLRDLPRLPLFDSVRSTTALALQQAIHMETDPQTISAYLIYLSQHTPVEEQAQHSDLALDVARLVVERSTIMSHLFSKLSPSAASDAVLSALLSIFSRYVRRMRQSKEGEEVYSWSESQDQVFLRWSSGETATMHILVVHAMVILLTLGPPRADDSEFQALLDIWFPEEKPLPTAFLVDTSEEALLLPDWLKLRMIRSEVLRLVDAALQDLEPQQLLLFVQSFGIPVSSMSKLLQFLDQAVAHDPQTLEQNIMDKSKMPGTCGVGSHTLTEPQPGQAFGAWVRAGVTLLRFADYMAHLVEVQHERGASGGQTFHSLLTASLPPRRDSTEAPKPKSSPEQPIGQGRIRVGTQLRVLGPEDDLAGMFLQIFPLSPDPRWQSSSPRPVALALQQALGQELARVVQGSPEVPGITVRVLQALATLLSSPHGGALVMSMHRSHFLACPLLRQLCQYQRCVPQDTGFSSLFLKVLLQMLQWLDSPGVEGGPLRAQLRMLASQASAGRRLSDVRGGLLRLAEALAFRQDLEVVSSTVRAVIATLRSGEQCSVEPDLISKVLQGLIEVRSPHLEELLTAFFSATADAASPFPACKPVVVVSSLLLQEEEPLAGGKPGADGGSLEAVRLGPSSGLLVDWLEMLDPEVVSSCPDLQLRLLFSRRKGKGQAQVPSFRPYLLTLFTHQSSWPTLHQCIRVLLGKSREQRFDPSASLDFLWACIHVPRIWQGRDQRTPQAGLGRKRREELVLRVQGPELISLVELILAEAETRSQDGDTAACSLIQARLPLLLSCCCGDDESVRKVTEHLSGCIQQWGDSVLGRRCRDLLLQLYLQRPELRVPVPEVLLHSEGAASSSVCKLDGLIHRFITLLADTSDSRALENRGADASMACRKLAVAHPLLLLRHLPMIAALLHGRTHLNFQEFRQQNHLSCFLHVLGLLELLQPHVFRSEHQGALWDCLLSFIRLLLNYRKSSRHLAAFINKFVQFIHKYITYNAPAAISFLQKHADPLHDLSFDNSDLVMLKSLLAGLSLPSRDDRTDRGLDEEGEEESSAGSLPLVSVSLFTPLTAAEMAPYMKRLSRGQTVEDLLEVLSDIDEMSRRRPEILSFFSTNLQRLMSSAEECCRNLAFSLALRSMQNSPSIAAAFLPTFMYCLGSQDFEVVQTALRNLPEYALLCQEHAAVLLHRAFLVGMYGQMDPSAQISEALRILHMEAVM

SEQ ID NO: 776 - protein, 904 aa, Homo sapiens
MAAIRALQQWCRQQCEGYRDVNICNMTTSFRDGLAFCAILHRHRPDLINFSALKKENIYENNKLAFRVAEEHLGIPALLDAEDMVALKVPDRLSILTYVSQYYNYFHGRSPIGGMAGVKRASEDSEEEPSGKKAPVQAAKLPSPAPARKPPLSPAQTNPVVQRRNEGAGGPPPKTDQALAGSLVSSTCGVCGKHVHLVQRHLADGRLYHRSCFRCKQCSCTLHSGAYKATGEPGTFVCTSHLPAAASASPKLTGLVPRQPGAMGVDSRTSCSPQKAQEANKARPSAWEPAAGNSPARASVPAAPNPAATSATSVHVRSPARPSESRLAPTPTEGKVRPRVTNSSPMGWSSAAPCTAAAASHPAVPPSAPDPRPATPQGGGAPRVAAPQTTLSSSSTSAATVDPPAWTPSASRTQQARNKFFQTSAVPPGTSLSGRGPTPSLVLSKDSSKEQARNFLKQALSALEEAGAPAPGRPSPATAAVPSSQPKTEAPQASPLAKPLQSSSPRVLGLPSRMEPPAPLSTSSTSQASALPPAGRRNLAESSGVGRVGAGSRPKPEAPMAKGKSTTLTQDMSTSLQEGQEDGPAGWRANLKPVDRRSPAERTLKPKEPRALAEPRAGEAPRKVSGSFAGSVHITLTPVRPDRTPRPASPGPSLPARSPSPPRRRRLAVPASLDVCDNWLRPEPPGQEARVQSWKEEEKKPHLQGKPGRPLSPANVPALPGETVTSPVRLHPDYLSPEEIQRQLQDIERRLDALELRGVELEKRLRAAEGDDAEDSLMVDWFWLIHEKQLLLRQESELMYKSKAQRLEEQQLDIEGELRRLMAKPEALKSLQERRREQELLEQYVSTVNDRSDIVDSLDEDRLREQEEDQMLRDMIEKLGLQRKKSKFRLSKIWSPKSKSSPSQ

SEQ ID NO: 777 - protein, 904 aa, Homo sapiens; identical to SEQ ID NO: 776

SEQ ID NO: 778 - protein, 156 aa, Homo sapiens
MTTNPKPNKALKVKKEAGENAPVLSDDELVSMSVRELNQHLRGLTKEEVTRLKQRRRTLKNRGYAASCRIKRVTQKEELERQRVELQQEVEKLARENSSMRLELDALRSKYEALQTFARTVARGPVAPSKVATTSVITIVKSTELSSTSVPFSAAS

SEQ ID NO: 779 - protein, 803 aa, Homo sapiens
MEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQDVQEQLDLQHKKCQEANQKIQELQASQEARADHEQQIKDLEQKLSLQEQDAAIVKNMKSELVRLPRLERELEQLREESALREMRETNGLLQEELEGLQRKLGRQEKMQETLVGLELENERLLAKLQSWERLDQTMGLSIRTPEDLSRFVVELQQRELALKDKNSAVTSSARGLEKARQQLQEELRQVSGQLLEERKKRETHEALARRLQKRVLLLTKERDGMRAILGSYDSELTPAEYSPQLTRRMREAEDMVQKVHSHSAEMEAQLSQALEELGGQKQRADMLEMELKMLKSQSSSAEQSFLFSREEADTLRLKVEELEGERSRLEEEKRMLEAQLERRALQGDYDQSRTKVLHMSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCSSSRPPAPRVPRCSYWRQSSHTPWASSSRCTCGARTASLPSSARSPSSSSAARPWRSLQARGHSRSHSAWPDLQVPCPASHRLGARPASPAPQGSSMTDRHAGTYVGLPAGAASTLSTCRPHASRSLVCGRRPPAWVPHLVK

SEQ ID NO: 780 - protein, 685 aa, Homo sapiens
MDGAGAEEVLAPLRLAVRQQGDLVRKLKEDKAPQVDVDKAVAELKARKRVLEAKELALQPKDDIVDRAKMEDTLKRRFFYDQAFAIYGGVSGLYDFGPVGCALKNNIIQTWRQHFIQEEQILEIDCTMLTPEPVLKTSGHVDKFADFMVKDVKNGECFRADHLLKAHLQKLMSDKKCSVEKKSEMESVLAQLDNYGQQELADLFVNYNVKSPITGNDLSPPVSFNLMFKTFIGPGGNMPGYLRPETAQGIFLNFKRLLEFNQGKLPFAAAQIGNSFRNEISPRSGLIRVREFTMAEIEHFVDPSEKDHPKFQNVADLHLYLYSAKAQVSGQSARKMRLGDAVEQGVINNTVLGYFIGRIYLYLTKVGISPDKLRFRQHMENEMAHYACDCWDAESKTSYGWIEIVGCADRSCYDLSCHARATKVPLVAEKPLKEPKTVNVVQFEPSKGAIGKAYKKDAKLVMEYLAICDECYITEMEMLLNEKGEFTIETEGKTFQLTKDMINVKRFQKTLYVEEVVPNVIEPSFGLGRIMYTVFEHTFHVREGDEQRTFFSFPAVVAPFKCSVLPLSQNQEFMPFVKELSEALTRHGVSHKVDDSSGSIGRRYARTDEIGVAFGVTIDFDTVNKTPHTATLRDRDSMRQIRAEISELPSIVQDLANGNITWADVEARYPLFEGQETGKKETIEE

SEQ ID NO: 781 - protein, 464 aa, Homo sapiens
MASESGKLWGGRFVGAVDPIMEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSHAVALTRDSERLLEVRKRINVLPLGSGAIAGNPLGVDRELLRAELNFGAITLNSMDATSERDFVAEFLFWASLCMTHLSRMAEDLILYCTKEFSFVQLSDAYSTGSSLMPQKKNPDSLELIRSKAGRVFGRCAGLLMTLKGLPSTYNKDLQEDKEAVFEVSDTMSAVLQVATGVISTLQIHQENMGQALSPDMLATDLAYYLVRKGMPFRQAHEASGKAVFMAETKGVALNQLSLQELQTISPLFSGDVICVWDYGHSVEQYGALGGTARSSVDWQIRQVRALLQAQQA

SEQ ID NO: 782 - protein, 148 aa, Homo sapiens
MEVKDANSALLSNYEVFQLLTDLKEQRKESGKNKHSSGQQNLNTITYETLKYISKTPCRHQSPEIVREFLTALKSHKLTKAEKLQLLNHRPVTAVEIQLMVEESEERLTEEQIEALLHTVTSILPAEPEAEQKKNTNSNVAMDEEDPA

SEQ ID NO: 783 - protein, 289 aa, Homo sapiens
MVVVTGREPDSRRQDGAMSSSDAEDDFLEPATPTATQAGHALPLLPQEFPEVVPLNIGGAHFTTRLSTLRCYEDTMLAAMFSGRHYIPTDSEGRYFIDRDGTHFGDVLNFLRSGDLPPRERVRAVYKEAQYYAIGPLLEQLENMQPLKGEKVRQAFLGLMPYYKDHLERIVEIARLRAVQRKARFAKLKVCVFKEEMPITPYECPLLNSLRFERSESDGQLFEHHCEVDVSFGPWEAVADVYDLLHCLVTDLSAQGLTVDHQCIGVCDKHLVNHYYCKRPIYEFKITWW

SEQ ID NO: 784 - protein, 491 aa, Homo sapiens
MSLKSERRGIHVDQSDLLCKKGCGYYGNPAWQGFCSKCWREEYHKARQKQIQEDWELAERLQREEEEAFASSQSSQGAQSLTFSKFEEKKTNEKTRKVTTVKKFFSASSRVGSKKEIQEAKAPSPSINRQTSIETDRVSKEFIEFLKTFHKTGQEIYKQTKLFLEGMHYKRDLSIEEQSECAQDFYHNVAERMQTRGKVPPERVEKIMDQIEKYIMTRLYKYVFCPETTDDEKKDLAIQKRIRALRWVTPQMLCVPVNEDIPEVSDMVVKAITDIIEMDSKRVPRDKLACITKCSKHIFNAIKITKNEPASADDFLPTLIYIVLKGNPPRLQSNIQYITRFCNPSRLMTGEDGYYFTNLCCAVAFIEKLDAQSLNLSQEDFDRYMSGQTSPRKQEAESWSPDACLGVKQMYKNLDLLSQLNERQERIMNEAKKLEKDLIDWTDGIAREVQDIVEKYPLEIKPPNQPLAAIDSENVENDKLPPPLQPQVYAG

SEQ ID NO: 785 - protein, 314 aa, Homo sapiens
MFSINPLENLKVYISSRPPLVVFMISVSAMAIAFLTLGYFFKIKEIKSPEMAEDWNTFLLRFNDLDLCVSENETLKHLTNDTTTPESTMTSGQARASTQSPQALEDSGPVNISVSITLTLDPLKPFGGYSRNVTHLYSTILGHQIGLSGREAHEEINITFTLPTAWSSDDCALHGHCEQVVFTACMTLTASPGVFPVTVQPPHCVPDTYSNATLWYKIFTTARDANTKYAQDYNPFWCYKGAIGKVYHALNPKLTVIVPDDDRSLINLHLMHTSYFLFVMVITMFCYAVIKGRPSKLRQSNPEFCPEKVALAEA

SEQ ID NO: 786 - protein, 118 aa, Homo sapiens
MRRAGLGEGVPPGNYGNYGYANSGYSACEEENERLTESLRSKVTAIKSLSIEIGHEVKTQNKLLAEMDSQFDSTTGFLGKTMGKLKILSRGSQTKLLCYMMLFSLFVFFIIYWIIKLR

SEQ ID NO: 787 - protein, 797 aa, Homo sapiens
MAALAYNLGKREINHYFSVRSAKVLALVAVLLLAACHLASRRYRGNDSCEYLLSSGRFLGEKVWQPHSCMMHKYKISEAKNCLVDKHIAFIGDSRIRQLFYSFVKIINPQFKEEGNKHENIPFEDKTASVKVDFLWHPEVNGSMKQCIKVWTEDSIAKPHVIVAGAATWSIKIHNGSSEALSQYKMNITSIAPLLEKLAKTSDVYWVLQDPVYEDLLSENRKMITNEKIDAYNEAAVSILNSSTRNSKSNVKMFSVSKLIAQETIMESLDGLHLPESSRETTAMILMNVYCNKILKPVDGSCCQPRPPVTLIQKLAACFFTLSIIGYLIFYIIHRNAHRKNKPCTDLESGEEKKNIINTPVSSLEILLQSFCKLGLIMAYFYMCDSANLFMKENKFYTHSSFFIPIIYILVLGVFYNENTKETKVLNREQTDEWKGWMQLVILIYHISGASTFLPVYMHIRVLVAAYLFQTGYGHFSYFWIKGDFGIYRVCQVLFRLNFLVVVLCIVMDRPYQFYYFVPLVTVWFMVIYVTLALWPQIIQKKANGNCFWHFGLLLKLGFLLLFICFLAYSQGAFEKIFSLWPLSKCFELKGNVYEWWFRWRLDRYVVFHGMLFAFIYLALQKRQILSEGKGEPLFSNKISNFLLFISVVSFLTYSIWASSCKNKAECNELHPSVSVVQILAFILIRNIPGYARSVYSSFFAWFGKISLELFICQYHIWLAADTRGILVLIPGNPMLNIIVSTFIFVCVAHEISQITNDLAQIIIPKDNSSLLKRLACIAAFFCGLLILSSIQDKSKH

SEQ ID NO: 788 - protein, 354 aa, Homo sapiens
MGKLVALVLLGVGLSLVGEMFLAFRERVNASREVEPVEPENCHLIEELESGSEDIDILPSGLAFISSGLKYPGMPNFAPDEPGKIFLMDLNEQNPRAQALEISGGFDKELFNPHGISIFIDKDNTVYLYVVNHPHMKSTVEIFKFEEQQRSLVYLKTIKHELLKSVNDIVVLGPEQFYATRDHYFTNSLLSFFEMILDLRWTYVLFYSPREVKVVAKGFCSANGITVSADQKYVYVADVAAKNIHIMEKHDNWDLTQLKVIQLGTLVDNLTVDPATGDILAGCHPNPMKLLNYNPEDPPGSEVLRIQNVLSEKPRVSTVYANNGSVLQGTSVASVYHGKILIGTVFHKTLYCEL

SEQ ID NO: 789 - protein, 354 aa, Homo sapiens
MGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVVCHPNGQKLFVYDPNNPPSSEVLRIQNILSEKPTVTTVYANNGSVLQGSSVASVYDGKLLIGTLYHRALYCEL

SEQ ID NO: 790 - protein, 411 aa, Homo sapiens
MKAARFVLRSAGSLNGAGLVPREVEHFSRYSPSPLSMKQLLDFGSENACERTSFAFLRQELPVRLANILKEIDILPTQLVNTSSVQLVKSWYIQSLMDLVEFHEKSPDDQKALSDFVDTLIKVRNRHHNVVPTMAQGIIEYKDACTVDPVTNQNLQYFLDRFYMNRISTRMLMNQHILIFSDSQTGNPSHIGSIDPNCDVVAVVQDAFECSRMLCDQYYLSSPELKLTQVNGKFPDQPIHIVYVPSHLHHMLFELFKNAMRATVEHQENQPSLTPIEVIVVLGKEDLTIKISDRGGGVPLRIIDRLFSYTYSTAPTPVMDNSRNAPLAGFGYGLPISRLYAKYFQGDLNLYSLSGYGTDAIIYLKALSSESIEKLPVFNKSAFKHYQMSSEADDWCIPSREPKNLAKEVAM

SEQ ID NO: 791 - protein, 675 aa, Homo sapiens
MAAAKVALTKRADPAELRTIFLKYASIEKNGEFFMSPNDFVTRYLNIFGESQPNPKTVELLSGVVDQTKDGLISFQEFVAFESVLCAPDALFMVAFQLFDKAGKGEVTFEDVKQVFGQTTIHQHIPFNWDSEFVQLHFGKERKRHLTYAEFTQFLLEIQLEHAKQAFVQRDNARTGRVTAIDFRDIMVTIRPHVLTPFVEECLVAAAGGTTSHQVSFSYFNGFNSLLNNMELIRKIYSTLAGTRKDVEVTKEEFVLAAQKFGQVTPMEVDILFQLADLYEPRGRMTLADIERIAPLEEGTLPFNLAEAQRQKASGDSARPVLLQVAESAYRFGLGSVAGAVGATAVYPIDLVKTRMQNQRSTGSFVGELMYKNSFDCFKKVLRYEGFFGLYRGLLPQLLGVAPEKAIKLTVNDFVRDKFMHKDGSVPLAAEILAGGCAGGSQVIFTNPLEIVKIRLQVAGEITTGPRVSALSVVRDLGFFGIYKGAKACFLRDIPFSAIYFPCYAHVKASFANEDGQVSPGSLLLAGAIAGMPAASLVTPADVIKTRLQVAARAGQTTYSGVIDCFRKILREEGPKALWKGAGARVFRSSPQFGVTLLTYELLQRWFYIDFGGVKPMGSEPVPKSRINLPAPNPDHVGGYKLAVATFAGIENKFGLYLPLFKPSVSTSKAIGGGP

SEQ ID NO: 792 - protein, 70 aa, Homo sapiens
MSEKKQPVDLGLLEEDDEFEEFPAEDWAGLDEDEDAHVWEDNWDDDNVEDDFSNQLRAELEKHGYKMETS

SEQ ID NO: 793 - protein, 125 aa, Homo sapiens
MPGRHVSRVRALYKRVLQLHRVLPPDLKSLGDQYVKDEFRRHKTVGSDEAQRFLQEWEVYATALLQQANENRQNSTGKACFGTFLPEEKLNDFRDEQIGQLQELMQEATKPNRQFSISESMKPKF

SEQ ID NO: 794 - protein, 561 aa, Homo sapiens
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDEPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 795 - protein, 561 aa, Homo sapiens; identical to SEQ ID NO: 794

SEQ ID NO: 796 - protein, 561 aa, Homo sapiens; identical to SEQ ID NO: 794

SEQ ID NO: 797 - protein, 1503 aa, Homo sapiens
MPGPPALRRRLLLLLLVLLIAGSAGAAPLPQTGAGEAPPAAEVSSSFVILCVCSLIILIVLIANCVSCCKDPEIDFKEFEDNFDDEIDFTPPAEDTPSVQSPAEVFTLSVPNISLPAPSQFQPSVEGLKSQVARHSLNYIQEIGNGWFGKVLLGEIYTGTSVARVIVKELKASANPKEQDTFLKNGEPYYILQHPNILQCVGQCVEAIPYLLVFEFCDLGDLKAYLRSEQEHMRGDSQTMLLQRMACEVAAGLAAMHKLHFLHSDLALRNCFLTSDLNVKVGDYGIGFSRYKEDYIETDDKKVFPLRWTAPELVTSFQDRLLTADQTKYSNIWSLGVTLWELFDNAAQPYSNLSNLDVLNQVIRERDTKLPKPQLEQPYSDRWYEVLQFCWLSPEKRPAAEDVHRLLTYLRLQSQRDSEVDFEQQWNALKPNTNSRDSSNNAAFPILDHFARDRLGREMEEVLTVTETSQGLSFEYVWEAAKHDHFDERSRGHLDEGLSYTSIFYPVEVFESSLSDPGPGKQDDSGQDVPLRVPGVVPVFDAHNLSVGSDYYIQLEEKSGSNLELDYPPALLTTDMDNPERTGPELSQLTALRSVELEESSTDEDFFQSSTDPKDSSLPGDLHVTSGPESPFNNIFNDVDKSEDLPSHQKIFDLMELNGVQADFKPATLSSSLDNPKESVITGHFEKEKPRKIFDSEPLCLSDNLMHQDNFDPLNVQELSENFLFLQEKNLLKGSLSSKEHINDLQTELKNAGFTEAMLETSCRNSLDTELQFAENKPGLSLLQENVSTKGDDTDVMLTGDTLSTSLQSSPEVQVPPTSFETEETPRRVPPDSLPTQGETQPTCLDVIVPEDCLHQDISPDAVTVPVEILSTDARTHSLDNRSQDSPGESEETLRLTESDSVLADDILASRVSVGSSLPELGQELHNKPFSEDHHSHRRLEKNLEAVETLNQLNSKDAAKEAGLVSALSSDSTSQDSLLEDSLSAPFPASEPSLETPDSLESVDVHEALLDSLGSHTPQKLVPPDKPADSGYETENLESPEWTLHPAPEGTADSEPATTGDGGHSGLPPNPVIVISDAGDGHRGTEVTPETFTAGSQGSYRDSAYFSDNDSEPEKRSEEVPGTSPSALVLVQEQPLPEPVLPEQSPAAQDSCLEARKSQPDESCLSALHNSSDLELRATPEPAQTGVPQQVHPTEDEASSPWSVLNAELSSGDDFETQDDRPCTLASTGTNTNELLAYTNSALDKSLSSHSEGPKLKEPDIEGKYLGKLGVSGMLDLSEDGMDADEEDENSDDSDEDLRAFNLHSLSSESEDETEHPVPIILSNEDGRHLRSLLKPTAANAPDPLPEDWKKEKKAVTFFDDVTVYLFDQETPTKELGPCGGEACGPDLSGPAPASGSPYLSRCINSESSTDEEGGGFEWDDDFSPDPFMSKTTSNLLSSKPSLQTSKYFSPPPPARSTEQSWPHSAPYSRFSISPANIASFSLTHLTDSDIEQGGSSEDGEKD

SEQ ID NO: 798 - protein, 3830 aa, Homo sapiens
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQAIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 799 - protein, 757 aa, Homo sapiens
MSNPGTRRNGSSIKIRLTVLCAKNLAKKDFFRLPDPFAKIVVDGSGQCHSTDTVKNTLDPKWNQHYDLYVGKTDSITISVWNHKKIHKKQGAGFLGCVRLLSNAISRLKDTGYQRLDLCKLNPSDTDAVRGQIVVSLQTRDRIGTGGSVVDCRGLLENEGTVYEDSGPGRPLSCFMEEPAPYTDSTGAAAGGGNCRFVESPSQDQRLQAQRLRNPDVRGSLQTPQNRPHGHQSPELPEGYEQRTTVQGQVYFLHTQTGVSTWHDPRIPSPSGTIPGGDAAFLYEFLLQGHTSEPRDLNSVNCDELGPLPPGWEVRSTVSGRIYFVDHNNRTTQFTDPRLHHIMNHQCQLKEPSQPLPLPSEGSLEDEELPAQRYERDLVQKLKVLRHELSLQQPQAGHCRIEVSREEIFEESYRQIMKMRPKDLKKRLMVKFRGEEGLDYGGVAREWLYLLCHEMLNPYYGLFQYSTDNIYMLQINPDSSINPDHLSYFHFVGRIMGLAVFHGHYINGGFTVPFYKQLLGKPIQLSDLESVDPELHKSLVWILENDITPVLDHTFCVEHNAFGRILQHELKPNGRNVPVTEENKKEYVRLYVNWRFMRGIEAQFLALQKGFNELIPQHLLKPFDQKELELIIGGLDKIDLNDWKSNTRLKHCVADSNIVRWFWQAVETFDEERRARLLQFVTGSTRVPLQGFKALQGSTGAAGPRLFTIHLIDANTDNLPKAHTCFNRIDIPPYESYEKLYEKLLTAVEETCGFAVE

SEQ ID NO: 800 - protein, 731 aa, Homo sapiens
MSNPGTRRNGSSIKIRLTVLCAKNLAKKDFFRLPDPFAKIVVDGSGQCHSTDTVKNTLDPKWNQHYDLYVGKTDSITISVWNHKKIHKKQGAGFLGCVRLLSNAISRLKDTGYQRLDLCKLNPSDTDAVRGQIVVSLQTRDRIGTGGSVVDCRGLLENEGTVYEDSGPGRPLSCFMEEPAPYTDSTGAAAGGGNCRFVESPSQDQRLQAQRLRNPDVRGSLQTPQNRPHGHQSPELPEGYEQRTTVQGQVYFLHTQTGVSTWHDPRIPRDLNSVNCDELGPLPPGWEVRSTVSGRIYFVDHNNRTTQFTDPRLHHIMNHQCQLKEPSQPLPLPSEGSLEDEELPAQRYERDLVQKLKVLRHELSLQQPQAGHCRIEVSREEIFEESYRQIMKMRPKDLKKRLMVKFRGEEGLDYGGVAREWLYLLCHEMLNPYYGLFQYSTDNIYMLQINPDSSINPDHLSYFHFVGRIMGLAVFHGHYINGGFTVPFYKQLLGKPIQLSDLESVDPELHKSLVWILENDITPVLDHTFCVEHNAFGRILQHELKPNGRNVPVTEENKKEYVRLYVNWRFMRGIEAQFLALQKGFNELIPQHLLKPFDQKELELIIGGLDKIDLNDWKSNTRLKHCVADSNIVRWFWQAVETFDEERRARLLQFVTGSTRVPLQGFKALQGSTGAAGPRLFTIHLIDANTDNLPKAHTCFNRIDIPPYESYEKLYEKLLTAVEETCGFAVE

SEQ ID NO: 801 - protein, 3830 aa, Homo sapiens; identical to SEQ ID NO: 798

SEQ ID NO: 802 - protein, 757 aa, Homo sapiens; identical to SEQ ID NO: 799

SEQ ID NO: 803 - protein, 731 aa, Homo sapiens; identical to SEQ ID NO: 800

SEQ ID NO: 804 - protein, 370 aa, Homo sapiens
MSLHQFLLEPITCHAWNRDRTQIALSPNNHEVHIYKKNGSQWVKAHELKEHNGHITGIDWAPKSDRIVTCGADRNAYVWSQKDGVWKPTLVILRINRAATFVKWSPLENKFAVGSGARLISVCYFESENDWWVSKHIKKPIRSTVLSLDWHPNNVLLAAGSCDFKCRVFSAYIKEVDEKPASTPWGSKMPFGQLMSEFGGSGTGGWVHGVSFSASGSRLAWVSHDSTVSVADASKSVQVSTLKTEFLPLLSVSFVSENSVVAAGHDCCPMLFNYDDRGCLTFVSKLDIPKQSIQRNMSAMERFRNMDKRATTEDRNTALETLHQNSITQVSIYEVDKQDCRKFCTTGIDGAMTIWDFKTLESSIQGLRIM

SEQ ID NO: 805 - protein, 372 aa, Homo sapiens
MAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWWVCKHIKKPIRSTVLSLDWHPNNVLLAAGSCDFKCRIFSAYIKEVEERPAPTPWGSKMPFGELMFESSSSCGWVHGVCFSASGSRVAWVSHDSTVCLADADKKMAVATLASETLPLLALTFITDNSLVAAGHDCFPVLFTYDAAAGMLSFGGRLDVPKQSSQRGLTARERFQNLDKKASSEGGTAAGAGLDSLHKNSVSQISVLSGGKAKCSQFCTTGMDGGMSIWDVKSLESALKDLKIK

SEQ ID NO: 806 - protein, 839 aa, Homo sapiens
MIMTESREVIDLDPPAETSQEQEDLFIVKVEEEDCTWMQEYNPPTFETFYQRFRHFQYHEASGPREALSQLRVLCCEWLRPELHTKEQILELLVLEQFLTILPEEFQPWVREHHPESGEEAVAVIENIQRELEERRQQIVACPDVLPRKMATPGAVQESCSPHPLTVDTQPEQAPQKPRLLEENALPVLQVPSLPLKDSQELTASLLSTGSQKLVKIEEVADVAVSFILEEWGHLDQSQKSLYRDDRKENYGSITSMGYESRDNMELIVKQISDDSESHWVAPEHTERSVPQDPDFAEVSDLKGMVQRWQVNPTVGKSRQNPSQKRDLDAITDISPKQSTHGERGHRCSDCGKFFLQASNFIQHRRIHTGEKPFKCGECGKSYNQRVHLTQHQRVHTGEKPYKCQVCGKAFRVSSHLVQHHSVHSGERPYGCNECGKNFGRHSHLIEHLKRHFREKSQRCSDKRSKNTKLSVKKKISEYSEADMELSGKTQRNVSQVQDFGEGCEFQGKLDRKQGIPMKEILGQPSSKRMNYSEVPYVHKKSSTGERPHKCNECGKSFIQSAHLIQHQRIHTGEKPFRCEECGKSYNQRVHLTQHQRVHTGEKPYTCPLCGKAFRVRSHLVQHQSVHSGERPFKCNECGKGFGRRSHLAGHLRLHSREKSHQCRECGEIFFQYVSLIEHQVLHMGQKNEKNGICEEAYSWNLTVIEDKKIELQEQPYQCDICGKAFGYSSDLIQHYRTHTAEKPYQCDICRENVGQCSHTKQHQKIYSSTKSHQCHECGRGFTLKSHLNQHQRIHTGEKPFQCKECGMNFSWSCSLFKHLRSHERTDPINTLSVEGSLL

SEQ ID NO: 807 - protein, 839 aa, Homo sapiens; identical to SEQ ID NO: 806

SEQ ID NO: 808 - protein, 502 aa, Homo sapiens
MDLIPNLAVETWLLLAVSLVLLYLYGTRTHGLFKRLGIPGPTPLPLLGNVLSYRQGLWKFDTECYKKYGKMWGTYEGQLPVLAITDPDVIRTVLVKECYSVFTNRRSLGPVGFMKSAISLAEDEEWKRIRSLLSPTFTSGKLKEMFPIIAQYGDVLVRNLRREAEKGKPVTLKDIFGAYSMDVITGTSFGVNIDSLNNPQDPFVESTKKFLKFGFLDPLFLSIILFPFLTPVFEALNVSLFPKDTINFLSKSVNRMKKSRLNDKQKHRLDFLQLMIDSQNSKETESHKALSDLELAAQSIIFIFAGYETTSSVLSFTLYELATHPDVQQKLQKEIDAVLPNKAPPTYDAVVQMEYLDMVVNETLRLFPVAIRLERTCKKDVEINGVFIPKGSMVVIPTYALHHDPKYWTEPEEFRPERFSKKKDSIDPYIYTPFGTGPRNCIGMRFALMNMKLALIRVLQNFSFKPCKETQIPLKLDTQGLLQPEKPIVLKVDSRDGTLSGE

SEQ ID NO: 809 - protein, 502 aa, Homo sapiens; identical to SEQ ID NO: 808

SEQ ID NO: 810 - protein, 453 aa, Homo sapiens
MISQFFILSSKGDPLIYKDFRGDSGGRDVAELFYRKLTGLPGDESPVVMHHHGRHFIHIRHSGLYLVVTTSENVSPFSLLELLSRLATLLGDYCGSLGEGTISRNVALVYELLDEVLDYGYVQTTSTEMLRNFIQTEAVVSKPFSLFDLSSVGLFGAETQQSKVAPSSAASRPVLSSRSDQSQKNEVFLDVVERLSVLIASNGSLLKVDVQGEIRLKSFLPSGSEMRIGLTEEFCVGKSELRGYGPGIRVDEVSFHSSVNLDEFESHRILRLQPPQGELTVMRYQLSDDLPSPLPFRLFPSVQWDRGSGRLQVYLKLRCDLLSKSQALNVRLHLPLPRGVVSLSQELSSPEQKAELAEGALRWDLPRVQGGSQLSGLFQMDVPGPPGPPSHGLSTSASPLGLGPASLSFELPRHTCSGLQVRFLRLAFRPCGNANPHKWVRHLSHSDAYVIRI

SEQ ID NO: 811 - protein, 677 aa, Homo sapiens
MAEEKKLKLSNTVLPSESMKVVAESMGIAQIQEETCQLLTDEVSYRIKEIAQDALKFMHMGKRQKLTTSDIDYALKLKNVEPLYGFHAQEFIPFRFASGGGRELYFYEEKEVDLSDIINTPLPRVPLDVCLKAHWLSIEGCQPAIPENPPPAPKEQQKAEATEPLKSAKPGQEEDGPLKGKGQGATTADGKGKEKKAPPLLEGAPLRLKPRSIHELSVEQQLYYKEITEACVGSCEAKRAEALQSIATDPGLYQMLPRFSTFISEGVRVNVVQNNLALLIYLMRMVKALMDNPTLYLEKYVHELIPAVMTCIVSRQLCLRPDVDNHWALRDFAARLVAQICKHFSTTTNNIQSRITKTFTKSWVDEKTPWTTRYGSIAGLAELGHDVIKTLILPRLQQEGERIRSVLDGPVLSNIDRIGADHVQSLLLKHCAPVLAKLRPPPDNQDAYRAEFGSLGPLLCSQVVKARAQAALQAQQVNRTTLTITQPRPTLTLSQAPQPGPRTPGLLKVPGSIALPVQTLVSARAAAPPQPSPPPTKFIVMSSSSSAPSTQQVLSLSTSAPGSGSTTTSPVTTTVPSVQPIVKLVSTATTAPPSTAPSGPGSVQKYIVVSLPPTGEGKGGPTSHPSPVPPPASSPSPLSGSALCGGKQEAGDSPPPAPGTPKANGSQPNSGSPQPAP

SEQ ID NO: 812 - protein, 667 aa, Homo sapiens
MAEEKKLKLSNTVLPSESMKVVAESMGIAQIQEETCQLLTDEVSYRIKEIAQDALKFMHMGKRQKLTTSDIDYALKLKNVEPLYGFHAQEFIPFRFASGGGRELYFYEEKEVDLSDIINTPLPRVPLDVCLKAHWLSIEGCQPAIPENPPPAPKEQQKAEATEPLKSAKPGQEEDGPLKGKGQGATTADGKGKEKKAPPLLEGAPLRLKPRSIHELSVEQQLYYKEITEACVGSCEAKRAEALQSIATDPGLYQMLPRFSTFISEGVRVNVVQNNLALLIYLMRMVKALMDNPTLYLEKYVHELIPAVMTCIVSRQLCLRPDVDNHWALRDFAARLVAQICKHFSTTTNNIQSRITKTFTKSWVDEKTPWTTRYGSIAGLAELGHDVIKTLILPRLQQEGERIRSVLDGPVLSNIDRIGADHVQSLLLKHCAPVLAKLRPPPDNQDAYRAEFGSLGPLLCSQVVKARAQAALQAQQPRPTLTLSQAPQPGPRTPGLLKVPGSIALPVQTLVSARAAAPPQPSPPPTKFIVMSSSSSAPSTQQVLSLSTSAPGSGSTTTSPVTTTVPSVQPIVKLVSTATTAPPSTAPSGPGSVQKYIVVSLPPTGEGKGGPTSHPSPVPPPASSPSPLSGSALCGGKQEAGDSPPPAPGTPKANGSQPNSGSPQPAP

SEQ ID NO: 813 - protein, 667 aa, Homo sapiens
MAEEKKLKLSNTVLPSESMKVVAESMGIAQIQEETCQLLTDEDALKFMHMGKRQKLTTSDIDYALKLKNVEPLYGFHAQEFIPFRFASGGGRELYFYEEKEVDLSDIINTPLPRVPLDVCLKAHWLSIEGCQPAIPENPPPAPKEQQKAEATEPLKSAKPGQEEDGPLKGKGQGATTADGKGKEKKAPPLLEGAPLRLKPRSIHELSVEQQLYYKEITEACVGSCEAKRAEALQSIATDPGLYQMLPRFSTFISEGVRVNVVQNNLALLIYLMRMVKALMDNPTLYLEKYVHELIPAVMTCIVSRQLCLRPDVDNHWALRDFAARLVAQICKHFSTTTNNIQSRITKTFTKSWVDEKTPWTTRYGSIAGLAELGHDVIKTLILPRLQQEGERIRSVLDGPVLSNIDRIGADHVQSLLLKHCAPVLAKLRPPPDNQDAYRAEFGSLGPLLCSQVVKARAQAALQAQQVNRTTLTITQPRPTLTLSQAPQPGPRTPGLLKVPGSIALPVQTLVSARAAAPPQPSPPPTKFIVMSSSSSAPSTQQVLSLSTSAPGSGSTTTSPVTTTVPSVQPIVKLVSTATTAPPSTAPSGPGSVQKYIVVSLPPTGEGKGGPTSHPSPVPPPASSPSPLSGSALCGGKQEAGDSPPPAPGTPKANGSQPNSGSPQPAP

SEQ ID NO: 814 - protein, 677 aa, Homo sapiens; identical to SEQ ID NO: 811

SEQ ID NO: 815 - protein, 340 aa, Homo sapiens
MSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAVAFFPNGYAFTTGSDDATCRLFDLRADQELLMYSHDNIICGITSVAFSRSGRLLLAGYDDFNCNIWDAMKGDRAGVLAGHDNRVSCLGVTDDGMAVATGSWDSFLKIWN

SEQ ID NO: 816 - protein, 914 aa, Homo sapiens
MASESSPLLAYRLLGEEGVALPANGAGGPGGASARKLSTFLGVVVPTVLSMFSIVVFLRIGFVVGHAGLLQALAMLLVAYFILALTVLSVCAIATNGAVQGGGAYFMISRTLGPEVGGSIGLMFYLANVCGCAVSLLGLVESVLDVFGADATGPSGLRVLPQGYGWNLLYGSLLLGLVGGVCTLGAGLYARASFLTFLLVSGSLASVLISFVAVGPRDIRLTPRPGPNGSSLPPRFGHFTGFNSSTLKDNLGAGYAEDYTTGAVMNFASVFAVLFNGCTGIMAGANMSGELKDPSRAIPLGTIVAVAYTFFVYVLLFFLSSFTCDRTLLQEDYGFFRAISLWPPLVLIGIYATALSASMSSLIGASRILHALARDDLFGVILAPAKVVSRGGNPWAAVLYSWGLVQLVLLAGKLNTLAAVVTVFYLVAYAAVDLSCLSLEWASAPNFRPTFSLFSWHTCLLGVASCLLMMFLISPGAAGGSLLLMGLLAALLTARGGPSSWGYVSQALLFHQVRKYLLRLDVRKDHVKFWRPQLLLLVGNPRGALPLLRLANQLKKGGLYVLGHVTLGDLDSLPSDPVQPQYGAWLSLVDRAQVKAFVDLTLSPSVRQGAQHLLRISGLGGMKPNTLVLGFYDDAPPQDHFLTDPAFSEPADSTREGSSPALSTLFPPPRAPGSPRALNPQDYVATVADALKMNKNVVLARASGALPPERLSRGSGGTSQLHHVDVWPLNLLRPRGGPGYVDVCGLFLLQMATILGMVPAWHSARLRIFLCLGPREAPGAAEGRLRALLSQLRIRAEVQEVVWGEGAGAGEPEAEEEGDFVNSGRGDAEAEALARSANALVRAQQGRGTGGGPGGPEGGDAEGPITALTFLYLPRPPADPARYPRYLALLETLTRDLGPTLLVHGVTPVTCTDL

SEQ ID NO: 817 - protein, 738 aa, Homo sapiens
MTSSGPGPRFLLLLPLLLPPAASASDRPRGRDPVNPEKLLVITVATAETEGYLRFLRSAEFFNYTVRTLGLGEEWRGGDVARTVGGGQKVRWLKKEMEKYADREDMIIMFVDSYDVILAGSPTELLKKFVQSGSRLLFSAESFCWPEWGLAEQYPEVGTGKRFLNSGGFIGFATTIHQIVRQWKYKDDDDDQLFYTRLYLDPGLREKLSLNLDHKSRIFQNLNGALDEVVLKFDRNRVRIRNVAYDTLPIVVHGNGPTKLQLNYLGNYVPNGWTPEGGCGFCNQDRRTLPGGQPPPRVFLAVFVEQPTPFLPRFLQRLLLLDYPPDRVTLFLHNNEVFHEPHIADSWPQLQDHFSAVKLVGPEEALSPGEARDMAMDLCRQDPECEFYFSLDADAVLTNLQTLRILIEENRKVIAPMLSRHGKLWSNFWGALSPDEYYARSEDYVELVQRKRVGVWNVPYISQAYVIRGDTLRMELPQRDVFSGSDTDPDMAFCKSFRDKGIFLHLSNQHEFGRLLATSRYDTEHLHPDLWQIFDNPVDWKEQYIHENYSRALEGEGIVEQPCPDVYWFPLLSEQMCDELVAEMEHYGQWSGGRHEDSRLAGGYENVPTVDIHMKQVGYEDQWLQLLRTYVGPMTESLFPGYHTKARAVMNFVVRYRPDEQPSLRPHHDSSTFTLNVALNHKGLDYEGGGCRFLRYDCVISSPRKGWALLHPGRLTHYHEGLPTTWGTRYIMVSFVDP

SEQ ID NO: 818 - protein, 154 aa, Homo sapiens
MVEKKTSVRSQDPGQRRVLDRAARQRRINRQLEALENDNFQDDPHAGLPQLGKRLPQFDDDADTGKKKKKTRGDHFKLRFRKNFQALLEEQNLSVAEGPNYLTACAGPPSRPQRPFCAVCGFPSPYTCVSCGARYCTVRCLGTHQETRCLKWTV

SEQ ID NO: 819 - protein, 152 aa, Homo sapiens
MEAVLNELVSVEDLLKFEKKFQSEKAAGSVSKSTQFEYAWCLVRTRYNDDIRKGIVLLEELLPKGSKEEQRDYVFYLAVGNYRLKEYEKALKYVRGLLQTEPQNNQAKELERLIDKAMKKDGLVGMAIVGGMALGVAGLAGLIGLAVSKSKS

SEQ ID NO: 820 - protein, 226 aa, Homo sapiens
MLLRLVSNSWPQVILPPRPPKVLGLQAPRRARKRAEGTASSNVFSMFDQSQIQEFKESLALSPRLERNGMISAHCNLCLTGSSNSPASASQAFTIMDQNRDGFIDKEDLRDTFAALGRINVKNEELEAMVKEAPGPINFTVFLTMFGEKLKGTDPEETILHAFKVFDTEGKGFVKADVIKEKLMTQADRFSEEEVKQMFAAFPPDVCGNLDYRNLCYVITHGEEKD

SEQ ID NO: 821 - protein, 254 aa, Homo sapiens
MSAELNVPIDPSAPACPEPGHKGMDYRDWVRRSYLELVTSNHHSVQALSWRKLYLSRAKLKASSRTSALLSGFAMVAMVEVQLETQYQYPRPLLIAFSACTTVLVAVHLFALLISTCILPNVEAVSNIHNLNSISESPHERMHPYIELAWGFSTVLGILLFLAEVVLLCWIKFLPVDARRQPGPPPGPGSHTGWQAALVSTIIMVPVGLIFVVFTIHFYRSLVRHKTERHNREIEELHKLKVQLDGHERSLQVL

SEQ ID NO: 822 - protein, 136 aa, Homo sapiens [sequence omitted]

SEQ ID NO: 823 - protein, 117 aa, Homo sapiens
MNAPPAFESFLLFEGEKKITINKDTKVPNACLFTINKEDHTLGNIIKSQLLKDPQVLFAGYKVPHPLEHKIIIRVQTTPDYSPQEAFTNAITDLISELSLLEERFRVAIKDKQEGIE

SEQ ID NO: 824 - protein, 116 aa, Homo sapiens
MNAPPAFESFLLFEGEKITINKDTKVPNACLFTINKEDHTLGNIIKSRACFPFAFCRDCQFPEASPATLPVQPAELCPRAHQLCAPALKRHLGGEAHPVHLHAGAASRPVQQPQHL

SEQ ID NO: 825 - protein, 115 aa, Homo sapiens
MNAPPAFESFLLFEGEKITINKDTKVPNACLFTINKEDHTLGNIIKSQLLKDPQVLFAGYKVPHPLEHKIIIRVQTTPDYSPQEAFTNAITDLISELSLLEERFRTCLLPLRLLP

SEQ ID NO: 826 - protein, 158 aa, Homo sapiens
MNAPPAFESFLLFEGEKITINKDTKVPNACLFTINKEDHTLGNIIKSQLLKDPQVLFAGYKVPHPLEHKIIIRVQTTPDYSPQEAFTNAITDLISELSLLEERFRVRAGPGGADGVGWTLARVPRPGTALACFFGGPQGEAAVMEEQGLPPQAPGHVD

SEQ ID NO: 827 - protein, 116 aa, Homo sapiens; identical to SEQ ID NO: 824

SEQ ID NO: 828 - protein, 115 aa, Homo sapiens; identical to SEQ ID NO: 825

SEQ ID NO: 829 - protein, 158 aa, Homo sapiens; identical to SEQ ID NO: 826

SEQ ID NO: 830 - protein, 146 aa, Homo sapiens
MTSERSRIPCLSAAAAEGTGKKQQEGRAMATLDRKVPSPEAFLGKPWSSWIDAAKLHCSDNVDLEEAGKEGGKSREVMRLNKEDMHLFGHYPAHDDFYLVVCSACNQVVKPQVFQSHCGRKQDNRRNEGISRSGPESSQAIEKHQV

SEQ ID NO: 831 - protein, 259 aa, Homo sapiens
MAPNIYLVRQRISRLGQRMSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVIFGFLNMILWGGNAWFVYKETSLHSPSNTSAPHSQGGIPPPTGI

SEQ ID NO: 832 - protein, 241 aa, Homo sapiens
MSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVIFGFLNMILWGGNAWFVYKETSLHSPSNTSAPHSQGGIPPPTGI

SEQ ID NO: 833 - protein, 780 aa, Homo sapiens
MAAPGGRSEPPQLPEYSCSYMVSRPVYSELAFQQQHERRLQERKTLRESLAKCCSCSRKRAFGVLKTLVPILEWLPKYRVKEWLLSDVISGVSTGLVATLQGMAYALLAAVPVGYGLYSAFFPILTYFIFGTSRHISVGPFPVVSLMVGSVVLSMAPDEHFLVSSSNGTVLNTTMIDTAARDTARVLIASALTLLVGIIQLIFGGLQIGFIVRYLADPLVGGFTTAAAFQVLVSQLKIVLNVSTKNYNGVLSIIYTLVEIFQNIGDTNLADFTAGLLTIVVCMAVKELNDRFRHKIPVPIPIEVIVTIIATAISYGANLEKNYNAGIVKSIPRGFLPPELPPVSLFSEMLAASFSIAVVAYAIAVSVGKVYATKYDYTIDGNQEFIAFGISNIFSGFFSCFVATTALSRTAVQESTGGKTQVAGIISAAIVMIAILALGKLLEPLQKSVLAAVVIANLKGMFMQLCDIPRLWRQNKIDAVIWVFTCIVSIILGLDLGLLAGLIFGLLTVVLRVQFPSWNGLGSIPSTDIYKSTKNYKNIEEPQGVKILRFSSPIFYGNVDGFKKCIKSTVGFDAIRVYNKRLKALRKIQKLIKSGQLRATKNGIISDAVSTNNAFEPDEDIEDLEELDIPTKEIEIQVDWNSELPVKVNVPKVPIHSLVLDCGAISFLDVVGVRSLRVIVKEFQRIDVNVYFASLQDYVIEKLEQCGFFDDNIRKDTFFLTVHDAILYLQNQVKSQEGQGSILETITLIQDCKDTLELIETELTEEELDVQDEAMRTLAS

SEQ ID NO: 834 - protein, 491 aa, Homo sapiens
MDHTDNELQGTNSSGSLGGLDVRRRIPIKLISKQANKAKPAPRTQRTINRMPAKAPPGDEEGFDYNEEERYDCKGGELFANQRRFPGHLFWDFQINILGEKDDTPVHFCDKCGLPIKIYGRMIPCKHVFCYDCAILHEKKGDKMCPGCSDPVQRIEQCTRGSLFMCSIVQGCKRTYLSQRDLQAHINHRHMRAGKPVTRASLENVHPPIAPPPTEIPERFIMPPDKHHMSHIPPKQHIMMPPPPLQHVPHEHYNQPHEDIRAPPAELSMAPPPPRSVSQETFRISTRKHSNLITVPIQDDSNSGAREPPPPAPAPAHHHPEYQGQPVVSHPHHIMPPQQHYAPPPPPPPPISHPMPHPPQAAGTPHLVYSQAPPPPMTSAPPPITPPPGHIIAQMPPYMNHPPPGPPPPQHGGPPVTAPPPHHYNPNSLPQFTEDQGTPSPPFTQPGGMSPGIWPAPRGPPPPPRLQGPPSQTPLPGPHHPDQTRYRPYYQ

SEQ ID NO: 835 - protein, 509 aa, Homo sapiens
MQSWSRVYCSLAKRGHFNRISHGLQGLSAVPLRTYADQPIDADVTVIGSGPGGYVAAIKAAQLGFKTVCIEKNETLGGTCLNVGCIPSKALLNNSHYYHMAHGTDFASRGIEMSEVRLNLDKMMEQKSTAVKALTGGIAHLFKQNKVVHVNGYGKITGKNQVTATKADGGTQVIDTKNILIATGSEVTPFPGITIDEDTIVSSTGALSLKKVPEKMVVIGAGVIGVELGSVWQRLGADVTAVEFLGHVGGVGIDMEISKNFQRILQKQGFKFKLNTKVTGATKKSDGKIDVSIEAASGGKAEVITCDVLLVCIGRRPFTKNLGLEELGIELDPRGRIPVNTRFQTKIPNIYAIGDVVAGPMLAHKAEDEGIICVEGMAGGAVHIDYNCVPSVIYTHPEVAWVGKSEEQLKEEGIEYKVGKFPFAANSRAKTNADTDGMVKILGQKSTDRVLGAHILGPGAGEMVNEAALALEYGASCEDIARVCHAHPTLSEAFREANLAASFGKSINF

SEQ ID NO: 836 - protein, 1966 aa, Homo sapiens
MWIPTEHEKYGVVIASFRGTVPYGLSLEIGDTVQILEKCDGWYRGFALKNPNIKGIFPSSYVHLKNACVKNKGQFEMVIPTEDSVITEMTSTLRDWGTMWKQLYVRNEGDLFHRLWHIMNEILDLRRQVLVGHLTHDRMKDVKRHITARLDWGNEQLGLDLVPRKEYAMVDPEDISITELYRLMEHRHRKKDTPVQASSHHLFVQMKSLMCSNLGEELEVIFSLFDSKENRPISERFFLRLNRNGLPKAPDKPERHCSLFVDLGSSELRKDIYITVHIIRIGRMGAGEKKNACSVQYRRPFGCAVLSIADLLTGETKDDLILKVYMCNTESEWYQIHENIIKKLNARYNLTGSNAGLAVSLQLLHGDIEQIRREYSSVFSHGVSITRKLGFSNIIMPGEMRNDLYITIERGEFEKGGKSVARNVEVTMFIVDSSGQTLKDFISFGSGEPPASEYHSFVLYHNNSPRWSELLKLPIPVDKFRGAHIRFEFRHCSTKEKGEKKLFGFSFVPLMQEDGRTLPDGTHELIVHKCEENTNLQDTTRYLKLPFSKGIFLGNNNQAMKATKESFCITSFLCSTKLTQNGDMLDLLKWRTHPDKITGCLSKLKEIDGSEIVKFLQDTLDTLFGILDENSQKYGSKVFDSLVHIINLLQDSKFHHFKPVMDTYIESHFAGALAYRDLIKVLKWYVDRITEAERQEHIQEVLKAQEYIFKYIVQSRRLFSLATGGQNEEEFRCCIQELLMSVRFFLSQESKGSGALSQSQAVFLSSFPAVYSELLKLFDVREVANLVQDTLGSLPTILHVDDSLQAIKLQCIGKTVESQLYTNPDSRYILLPVVLHHLHIHLQEQKDLIMCARILSNVFCLIKKNSSEKSVLEEIDVIVASLLDILLRTILEITSRPQPSSSAMRFQFQDVTGEFVACLLSLLRQMTDRHYQQLLDSFNTKEELRDFLLQIFTVFRILIRPEMFPKDWTVMRLVANNVIITTVLYLSDALRKNFLNENFDYKIWDSYFYLAVIFINQLCLQLEMFTPSKKKKVLEKYGDMRVTMGCEIFSMWQNLGEHKLHFIPALIGPFLEVTLIPQPGLRNVMIPIFHDMMDWEQRRSGNFKQVEAKLIDKLDSLMSEGKGDETYRELFNSILLKKIERETWRESGVSLIATVTRLMERLLDYRDCMKMGEVDGKKIGCTVSLLNFYKTELNKEEMYIRYIHKLYDLHLKAQNFTEAAYTLLLYDELLEWSDRPLREFLTYPMQTEWQRKEHLHLTIIQNFDRGKCWENGIILCRKIAEQYESYYDYRNLSKMRMMEASLYDKIMDQQRLEPEFFRVGFYGKKFPFFLRNKEFVCRGHDYERLEAFQQRMLNEFPHAIAMQHANQPDETIFQAEAQYLQIYAVTPIPESQEVLQREGVPDNIKSFYKVNHIWKFRYDRPFHKGTKDKENEFKSLWVERTSLYLVQSLPGISRWFEVEKREVVEMSPLENAIEVLENKNQQLKTLISQCQTRQMQNINPLTMCLNGVIDAAVNGGVSRYQEAFFVKEYILSHPEDGEKIARLRELMLEQAQILEFGLAVHEKFVPQDMRPLHKKLVDQFFVMKSSLGIQEFSACMQASPVHFPNGSPRVCRNSAPASVSPDGTRVIPRRSPLSYPAVNRYSSSSLSSQASAEVSNITGQSESSDEVFNMQPSPSTSSLSSTHSASPNVTSSAPSSARASPLLSDKHKHSRENSCLSPRERPCSAIYPTPVEPSQRMLFNHIGDGALPRSDPNLSAPEKAVNPTPSSWSLDSGKEAKNMSDSGKLISPPVPPRPTQTASPARHTTSVSPSPAGRSPLKGSVQSFTPSPVEYHSPGLISNSPVLSGSYSSGISSLSRCSTSETSGFENQVNEQSAPLPVPVPVPVPSYGGEEPVRKESKTPPPYSVYERTLRRPVPLPHSLSIPVTSEPPALPPKPLAARSSHLENGARRTDPGPRPRPLPRKVSQL

SEQ ID NO: 837 - protein, 1331 aa, Homo sapiens
MRGAPARLLLPLLPWLLLLLAPEARGAPGCPLSIRSCKCSGERPKGLSGGVPGPARRRVVCSGGDLPEPPEPGLLPNGTVTLLLSNNKITGLRNGSFLGLSLLEKLDLRNNIISTVQPGAFLGLGELKRLDLSNNRIGCLTSETFQGLPRLLRLNISGNIFSSLQPGVFDELPALKVVDLGTEFLTCDCHLRWLLPWAQNRSLQLSEHTLCAYPSALHAQALGSLQEAQLCCEGALELHTHHLIPSLRQVVFQGDRLPFQCSASYLGNDTRIRWYHNRAPVEGDEQAGILLAESLIHDCTFITSELTLSHIGVWASGEWECTVSMAQGNASKKVEIVVLETSASYCPAERVANNRGDFRWPRTLAGITAYQSCLQYPFTSVPLGGGAPGTRASRRCDRAGRWEPGDYSHCLYTNDITRVLYTFVLMPINASNALTLAHQLRVYTAEAASFSDMMDVVYVAQMIQKFLGYVDQIKELVEVMVDMASNLMLVDEHLLWLAQREDKACSRIVGALERIGGAALSPHAQHISVNARNVALEAYLIKPHSYVGLTCTAFQRREGGVPGTRPGSPGQNPPPEPEPPADQQLRFRCTTGRPNVSLSSFHIKNSVALASIQLPPSLFSSLPAALAPPVPPDCTLQLLVFRNGRLFHSHSNTSRPGAAGPGKRRGVATPVIFAGTSGCGVGNLTEPVAVSLRHWAEGAEPVAAWWSQEGPGEAGGWTSEGCQLRSSQPNVSALHCQHLGNVAVLMELSAFPREVGGAGAGLHPVVYPCTALLLLCLFATIITYILNHSSIRVSRKGWHMLLNLCFHIAMTSAVFAGGITLTNYQMVCQAVGITLHYSSLSTLLWMGVKARVLHKELTWRAPPPQEGDPALPTPSPMLRFYLIAGGIPLIICGITAAVNIHNYRDHSPYCWLVWRPSLGAFYIPVALILLITWIYFLCAGLRLRGPLAQNPKAGNSRASLEAGEELRGSTRLRGSGPLLSDSGSLLATGSARVGTPGPPEDGDSLYSPGVQLGALVTTHFLYLAMWACGALAVSQRWLPRVVCSCLYGVAASALGLFVFTHHCARRRDVRASWRACCPPASPAAPHAPPRALPAAAEDGSPVFGEGPPSLKSSPSGSSGHPLALGPCKLTNLQLAQSQVCEAGAAAGGEGEPEPAGTRGNLAHRHPNNVHHGRRAHKSRAKGHRAGEACGKNRLKALRGGAAGALELLSSESGSLHNSPTDSYLGSSRNSPGAGLQLEGEPMLTPSEGSDTSAAPLSEAGRAGQRRSASRDSLKGGGALEKESHRRSYPLNAASLNGAPKGGKYDDVTLMGAEVASGGCMKTGLWKSETTV

SEQ ID NO: 838 - protein, 1331 aa, Homo sapiens; identical to SEQ ID NO: 837

SEQ ID NO: 839 - protein, 419 aa, Homo sapiens
MPGRGRCPDCGSTELVEDSHYSQSQLVCSDCGCVVTEGVLTTTFSDEGNLREVTYSRSTGENEQVSRSQQRGLRRVRDLCRVLQLPPTFEDTAVAYYQQAYRHSGIRAARLQKKEVLVGCCVLITCRQHNWPLTMGAICTLLYADLDVFSSTYMQIVKLLGLDVPSLCLAELVKTYCSSFKLFQASPSVPAKYVEDKEKMLSRTMQLVELANETWLVTGRHPLPVITAATFLAWQSLQPADRLSCSLARFCKLANVDLPYPASSRLQELLAVLLRMAEQLAWLRVLRLDKRSVVKHIGDLLQHRQSLVRSAFRDGTAEVETREKEPPGWGQGQGEGEVGNNSLGLPQGKRPASPALLLPPCMLKSPKRICPVPPVSTVTGDENISDSEIEQYLRTPQEVRDFQRAQAARQAATSVPNPP

SEQ ID NO: 840 - protein, 628 aa, Homo sapiens
MAAAGAGPGQEAGAGPGPGAVANATGAEEGEMKPVAAGAAAPPGEGISAAPTVEPSSGEAEGGEANLVDVSGGLETESSNGKDTLEGAGDTSEVMDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRHRPGKTTWPNNIVKTMSKERDVFLVKEHPDPGSKDPEEDYPKFGLLDQDLSNIGPAYDNQKQSSAVSTSGNLNGGIAAGSSGKGRGAKRKQQDGGTTGTTKKARSDPLFSAQRLPPHGYPLEHPFNKDGYRYILAEPDPQAPDPEKLEIDCWAGKPISGDLYRACLYERVLLALHDRAPQLKISDDRLTVVGEKGYSMVRASHGVRKGAWYFEITVDEMPPDTAARLGWSQPLGNLQAPLGYDKFSYSWRSKKGTKFHQSIGKHYSSGYGQGDVLGFYINLPEDTETAKSLPDTYKDKALIKFKSYLYFEEKDFVDKAEKSLKQTPHSEIIFYKNGVNQGVAYKDIFEGVYFPAISLYKSCTVSINFGPCFKYPPKDLTYRPMSDMGWGAVVEHTLADVLYHVETEVDGRRSPPWEP

SEQ ID NO: 841 - protein, 133 aa, Homo sapiens
MNYMPGTASLIEDIDKKHLVLLRDGRTLIGFLRSIDQFANLVLHQTVERIHVGKKYGDIPRGIFVVRGENVVLLGEIDLEKESDTPLQQVSIEEILEEQRVEQQTKLEAEKLKVQALKDRGLSIPRADTLDEY

SEQ ID NO: 842 - protein, 457 aa, Homo sapiens
MSALRRSGYGPSDGPSYGRYYGPGGGDVPVHPPPPLYPLRPEPPQPPISWRVRGGGPAETTWLGEGGGGDGYYPSGGAWPEPGRAGGSHQEQPPYPSYNSNYWNSTARSRAPYPSTYPVRPELQGQSLNSYTNGAYGPTYPPGPGANTASYSGAYYAPGYTQTSYSTEVPSTYRSSGNSPTPVSRWIYPQQDCQTEAPPLRGQVPGYPPSQNPGMTLPHYPYGDGNRSVPQSGPTVRPQEDAWASPGAYGMGGRYPWPSSAPSAPPGNLYMTESTSPWPSSGSPQSPPSPPVQQPKDSSYPYSQSDQSMNRHNFPCSVHQYESSGTVNNDDSDLLDSQVQYSAEPQLYGNATSDHPNNQDQSSSLPEECVPSDESTPPSIKKIIHVLEKVQYLEQEVEEFVGKKTDKAYWLLEEMLTKELLELDSVETGGQDSVRQARKEAVCKIQAILEKLEKKGL

SEQ ID NO: 843 - protein, 711 aa, Homo sapiens
MSSVQSQQEQLSQSDPSPSPNSCSSFELIDMDAGSLYEPVSPHWFYCKIIDSKETWIPFNSEDSQQLEEAYSSGKGCNGRVVPTDGGRYDVHLGERMRYAVYWDELASEVRRCTWFYKGDKDNKYVPYSESFSQVLEETYMLAVTLDEWKKKLESPNREIIILHNPKLMVHYQPVAGSDDWGSTPTEQGRPRTVKRGVENISVDIHCGEPLQIDHLVFVVHGIGPACDLRFRSIVQCVNDFRSVSLNLLQTHFKKAQENQQIGRVEFLPVNWHSPLHSTGVDVDLQRITLPSINRLRHFTNDTILDVFFYNSPTYCQTIVDTVASEMNRIYTLFLQRNPDFKGGVSIAGHSLGSLILFDILTNQKDSLGDIDSEKDSLNIVMDQGDTPTLEEDLKKLQLSEFFDIFEKEKVDKEALALCTDRDLQEIGIPLGPRKKILNYFSTRKNSMGIKRPAPQPASGANIPKESEFCSSSNTRNGDYLDVGIGQVSVKYPRLIYKPEIFFAFGSPIGMFLTVRGLKRIDPNYRFPTCKGFFNIYHPFDPVAYRIEPMVVPGVEFEPMLIPHHKGRKRMHLELREGLTRMSMDLKNNLLGSLRMAWKSFTRAPYPALQASETPEETEAEPESTSEKPSDVNTEETSVAVKEEVLPINVGMLNGGQRIDYVLQEKPIESFNEYLFALQSHLCYWESEDTVLLVLKEIYQTQGIFLDQPLQ

SEQ ID NO: 844 - protein, 645 aa, Homo sapiens
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYPWWPCMVSSDPQLEVHTKINTRGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWKTAAARKSLPASITMHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGSADRGVQGSVRFSDSSVSAAIEETVD

SEQ ID NO: 845 - protein, 1437 aa, Homo sapiens
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYPWWPCMVSSDPQLEVHTKINTRGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWKTAAARKSLPASITMHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGASEISDSCKPLKKRSRASTDVEMTSSAYRDTSDSDSRGLSDLQVGFGKQVDSPSATADADVSDVQSMDSSLSRRGTGMSKKDTVCQICESSGDSLIPCEGECCKHFHLECLGLASLPDSKFICMECKTGQHPCFSCKVSGKDVKRCSVGACGKFYHEACVRKFPTAIFESKGFRCPQHCCSACSMEKDIHKASKGRMMRCLRCPVAYHSGDACIAAGSMLVSSYILICSNHSKRSSNSSAVNVGFCFVCARGLIVQDHSDPMFSSYAYKSHYLLNESNRAELMKLPMIPSSSASKKKCEKGGRLLCCESCPASFHPECLSIEMPEGCWNCNDCKAGKKLHYKQIVWVKLGNYRWWPAEICNPRSVPLNIQGLKHDLGDFPVFFFGSHDYYWVHQGRVFPYVEGDKSFAEGQTSINKTFKKALEEAAKRFQELKAQRESKEALEIEKNSRKPPPYKHIKANKVIGKVQIQVADLSEIPRCNCKPADENPCGLESECLNRMLQYECHPQVCPAGDRCQNQCFTKRLYPDAEIIKTERRGWGLRTKRSIKKGEFVNEYVGELIDEEECRLRIKRAHENSVTNFYMLTVTKDRIIDAGPKGNYSRFMNHSCNPNCETQKWTVNGDVRVGLFALCDIPAGMELTFNYNLDCLGNGRTECHCGADNCSGFLGVRPKSACASTNEEKAKNAKLKQKRRKIKTEPKQMHEDYCFQCGDGGELVMCDKKDCPKAYHLLCLNLTQPPYGKWECPWHQCDECSSAAVSFCEFCPHSFCKDHEKGALVPSALEGRLCCSEHDPMAPVSPEYWSKIKCKWESQDHGEEVKE

SEQ ID NO: 846 - protein, 1199 aa, Homo sapiens
MPLTGVEPARMNRKKGDKGFESPRPYKLTHQVVCINNINFQRKSVVGFVELTIFPTVANLNRIKLNSKQCRIYRVRINDLEAAFIYNDPTLEVCHSESKQRNLNYFSNAYAAAVSAVDPDAGNGELCIKVPSELWKHVDELKVLKIHINFSLDQPKGGLHFVVPSVEGSMAERGAHVFSCGYQNSTRFWFPCVDSYSELCTWKLEFTVDAAMVAVSNGDLVETVYTHDMRKKTFHYMLTIPTAASNISLAIGPFEILVDPYMHEVTHFCLPQLLPLLKHTTSYLHEVFEFYEEILTCRYPYSCFKTVFIDEAYVEVAAYASMSIFSTNLLHSAMIIDETPLTRRCLAQSLAQQFFGCFISRMSWSDEWVLKGISGYIYGLWMKKTFGVNEYRHWIKEELDKIVAYELKTGGVLLHPIFGGGKEKDNPASHLHFSIKHPHTLSWEYYTMFQCKAHLVMRLIENRISMEFMLQVFNKLLSLASTASSQKFQSHMWSQMLVSTSGFLKSISNVSGKDIQPLIKQWVDQSGVVKFYGSFAFNRKRNVLELEIKQDYTSPGTQKYVGPLKVTVQELDGSFNHTLQIEENSLKHDIPCHSKSRRNKKKKIPLMNGEEVDMDLSAMDADSPLLWIRIDPDMSVLRKVEFEQADFMWQYQLRYERDVVAQQESILALEKFPTPASRLALTDILEQEQCFYRVRMSACFCLAKIANSMVSTWTGPPAMKSLFTRMFCCKSCPNIVKTNNFMSFQSYFLQKTMPVAMALLRDVHNLCPKEVLTFILDLIKYNDNRKNKFSDNYYRAEMIDALANSVTPAVSVNNEVRTLDNLNPDVRLILEEITRFLNMEKLLPSYRHTITVSCLRAIRVLQKNGHVPSDPALFKSYAEYGHFVDIRIAALEAVVDYTKVDRSYEELQWLLNMIQNDPVPYVRHKILNMLTKNPPFTKNMESPLCNEALVDQLWKLMNSGTSHDWRLRCGAVDLYFTLFGLSRPSCLPLPELGLVLNLKEKKAVLNPTIIPESVAGNQEAANNPSSHPQLVGFQNPFSSSQDEEEIDMDTVHDSQAFISHHLNMLERPSTPGLSKYRPASSRSALIPQHSAGCDSTPTTKPQWSLELARKGTGKEQAPLEMSMHPAASAPLSVFTKESTASKHSDHHHHHHHEHKKKKKKHKHKHKHKHKHDSKEKDKEPFTFSSPASGRSIRSPSLSD

SEQ ID NO: 847 - protein, 178 aa, Homo sapiens
MSSFSRAPQQWATFARIWYLLDGKMQPPGKLAAMASIRLQGLHKPVYHALSDCGDHVVIMNTRHIAFSGNKWEQKVYSSHTGYPGGFRQVTAAQLHLRDPVAIVKLAIYGMLPKNLHRRTMMERLHLFPDEYIPEDILKNLVEELPQPRKIPKRLDEYTQEEIDAFPRLWTPPEDYRL

SEQ ID NO: 848 - protein, 552 aa, Homo sapiens
MHCERFLCILRIIGTTLFGVSLLLGITAAYIVGYQFIQTDNYYFSFGLYGAFLASHLIIQSLFAFLEHRKMKKSLETPIKLNKTVALCIAAYQEDPDYLRKCLQSVKRLTYPGIKVVMVIDGNSEDDLYMMDIFSEVMGRDKSATYIWKNNFHEKGPGETDESHKESSQHVTQLVLSNKSICIMQKWGGKREVMYTAFRALGRSVDYVQVCDSDTMLDPASSVEMVKVLEEDPMVGGVGGDVQILNKYDSWISFLSSVRYWMAFNIERACQSYFGCVQCISGPLGMYRNSLLHEFVEDWYNQEFMGNQCSFGDDRHLTNRVLSLGYATKYTARSKCLTETPIEYLRWLNQQTRWSKSYFREWLYNAMWFHKHHLWMTYEAIITGFFPFFLIATVIQLFYRGKIWNILLFLLTVQLVGLIKSSFASCLRGNIVMVFMSLYSVLYMSSLLPAKMFAIATINKAGWGTSGRKTIVVNFIGLIPVSVWFTILLGGVIFTIYKESKRPFSESKQTVLIVGTLLYACYWVMLLTLYVVLINKCGRRKKGQQYDMVLDV

SEQ ID NO: 849 - protein, 251 aa, Homo sapiens
MSDIGDWFRSIPAITRYWFAATVAVPLVGKLGLISPAYLFLWPEAFLYRFQIWRPITATFYFPVGPGTGFLYLVNLYFLYQYSTRLETGAFDGRPADYLFMLLFNWICIVITGLAMDMQLLMIPLIMSVLYVWAQLNRDMIVSFWFGTRFKACYLPWVILGFNYIIGGSVINELIGNLVGHLYFFLMFRYPMDLGGRNFLSTPQFLYRWLPSRRGGVSGFGVPPASMRRAADQNGGGGRHNWGQGFRLGDQ

SEQ ID NO: 850 - protein, 251 aa, Homo sapiens; identical to SEQ ID NO: 849

SEQ ID NO: 851 - protein, 1066 aa, Homo sapiens
MQSTDLGNKESGKIWHRKPSPATRDGIIVNIIHNTSDYHPKVLRFLNVAFDGTGDCLIAGDHQGNIYVFDLHGNRFNLVQRTAQACTALAFNLRRKSEFLVALADYSIKCFDTVTKELVSWMRGHESSVFSISVHASGKYAITTSSDTAQLWDLDTFQRKRKLNIRQSVGIQKVFFLPLSNTILSCFKDNSIFAWECDTLFCKYQLPAPPESSSILYKVFAVTRDGRILAAGGKSNHLHLWCLEARQLFRIIQMPTKVRAIRHLEFLPDSFDAGSNQVLGVLSQDGIMRFINMQTCKLLFEIGSLDEGISSSAISPHGRYIASIMENGSLNIYSVQALTQEINKPPPPLVKVIEDLPNNKLSSSDLKMKVTSGRVQQPAKSRESKMQTRILKQDLTGDFESKKNELPDGLNKKRLQILLKGYGEYPTKYRMFIWRSLLQLPENHTAFSTLIDKGTHVAFLNLQKKYPIKSRKLLRVLQRTLSALAHWSVIFSDTPYLPLLAFPFVKLFQNNQLICFEVIATLIINWCQHWFEYFPNPPINILSMIENVLAFHDKELLQHFIDHDITSQLYAWPLLETVFSEVLTREEWLKLFDNIFSNHPSFLLMTVVAYNICSRTPLLSCNLKDDFEFFFHHRNNLDINVVIRQVYHLMETTPTDIHPDSMLNVFVALTKGQYPVFNQYPKFIVDYQTQERERIRNDELDYLRERQTVEDMQAKVDQQRVEDEAWYQKQELLRKAEETRREMLLQEEEKMIQQRQRLAAVKRELKVKEMHLQDAARRRFLKLQQDQQEMELRRLDDEIGRKVYMRDREIAATARDLEMRQLELESQKRLYEKNLTENQEALAKEMRADADAYRRKVDLEEHMFHKLIEAGETQSQKTQKVIKENLAKAEQACLNTDWQIQSLHKQKCDDLQRNKCYQEVAKLLRENRRKEIEIINAMVEEEAKKWKEAEGKEFRLRSAKKASALSDASRKWFLKQEINAAVEHAENPCHKEEPRFQNEQDSSCLPRTSQLNDSSEMDPSTQISLNRRAVEWDTTGQNLIKKVRNLRQRLTARARHRCQTPHLLAA

SEQ ID NO: 852 - protein, 205 aa, Homo sapiens
MEGNGPAAVHYQPASPPRDACVYSSCYCEENIWKLCEYIKNHDQYPLEECYAVFISNERKMIPIWKQQARPGDGPVIWDYHVVLLHVSSGGQNFIYDLDTVLPFPCLFDTYVEDAFKSDDDIHPQFRRKFRVIRADSYLKNFASDRSHMKDSSGNWREPPPPYPCIETGDSKMNLNDFISMDPKVGWGAVYTLSEFTHRFGSKNC

SEQ ID NO: 853 - protein, 316 aa, Homo sapiens
MGNRHAKASSPQGFDVDRDAKKLNKACKGMGTNEAAIIEILSGRTSDERQQIKQKYKATYGKELEEVLKSELSGNFEKTALALLDRPSEYAARQLQKAMKGLGTDESVLIEFLCTRTNKEIIAIKEAYQRLFDRSLESDVKGDTSGNLKKILVSLLQANRNEGDDVDKDLAGQDAKDLYDAGEGRWGTDELAFNEVLAKRSYKQLRATFQAYQILIGKDIEEAIEEETSGDLQKAYLTLVRCAQDCEDYFAERLYKSMKGAGTDEETLIRIVVTRAEVDLQGIKAKFQEKYQKSLSDMVRSDTSGDFRKLLVALLH

SEQ ID NO: 854 - protein, 664 aa, Homo sapiens
MAAVGPPQQQVRMAHQQVWAALEVALRVPCLYIIDAIFNSYPDSSQSRFCIVLQIFLRLFGVFASSIVLILSQRSLFKFYTYSSAFLLAATSVLVNYYASLHIDFYGAYNTSAFGIELLPRKGPSLWMALIVLQLTFGIGYVTLLQIHSIYSQLIILDLLVPVIGLITELPLHIRETLLFTSSLILTLNTVFVLAVKLKWFYYSTRYVYLLVRHMYRIYGLQLLMEDTWKRIRFPDILRVFWLTRVTAQATVLMYILRMANETDSFFISWDDFWDLICNLIISGCDSTLTVLGMSAVISSVAHYLGLGILAFIGSTEEDDRRLGFVAPVLFFILALQTGLSGLRPEERLIRLSRNMCLLLTAVLHFIHGMTDPVLMSLSASHVSSFRRHFPVLFVSACLFILPVLLSYVLWHHYALNTWLFAVTAFCVELCLKVIVSLTVYTLFMIDGYYNVLWEKLDDYVYYVRSTGSIIEFIFGVVMFGNGAYTMMFESGSKIRAFMMCLHAYFNIYLQAKNGWKTFMNRRTAVKKINSLPEIKGSRLQEINDVCAICYHEFTTSARITPCNHYFHALCLRKWLYIQDTCPMCHQKVYIEDDIKDNSNVSNNNGFIPPNETPEEAVREAAAESDRELNEDDSTDCDDDVQRERNGVIQHTGAAAEEFNDDTD

SEQ ID NO: 855 - protein, 1159 aa, Homo sapiens
MLDFLAENNLCGQAILRIVSCGNAIIAELLRLSEFIPAVFRLKDRADQQKYGDIIFDFSYFKGPELWESKLDAKPELQDLDEEFRENNIEIVTRFYLAFQSVHKYIVDLNRYLDDLNEGVYIQQTLETVLLNEDGKQLLCEALYLYGVMLLVIDQKIEGEVRERMLVSYYRYSAARSSADSNMDDICKLLRSTGYSSQPGAKRPSNYPESYFQRVPINESFISMVIGRRRSDDIYNQVSAYPLPEHRSTALANQAAMLYVILYFEPSILHTHQAKMREIVDKYFPDNWVISIYMGITVNLVDAWEPYKAAKTALNNTLDLSNVREQASRYATVSERVHAQVQQFLKEGYLREEMVLDNIPKLLNCLRDCNVAIRWLMLHTADSACDPNNKRLRQIKDQILTDSRYNPRILFQLLLDTAQFEFILKEMFKQMLSEKQTKWEHYKKEGSERMTELADVFSGVKPLTRVEKNENLQAWFREISKQILSLNYDDSTAAGRKTVQLIQALEEVQEFHQLESNLQVCQFLADTRKFLHQMIRTINIKEEVLITMQIVGDLSFAWQLIDSFTSIMQESIRVNPSMVTKLRATFLKLASALDLPLLRINQANSPDLLSVSQYYSGELVSYVRKVLQIIPESMFTSLLKIIKLQTHDIIEVPTRLDKDKLRDYAQLGPRYEVAKLTHAISIFTEGILMMKTTLVGIIKVDPKQLLEDGIRKELVKRVAFALHRGLIFNPRAKPSELMPKLKELGATMDGFHRSFEYIQDYVNIYGLKIWQEEVSRIINYNVEQECNNFLRTKIQDWQSMYQSTHIPIPKFTPVDESVTFIGRLCREILRITDPKMTCHIDQLNTWYDMKTHQEVTSSRLFSEIQTTLGTFGLNGLDRLLCFMIVKELQNFLSMFQKIILRDRTVQDTLKTLMNAVSPLKSIVANSNKIYFSAIAKTQKIWTAYLEAIMKVGQMQILRQQIANELNYSCRFDSKHLAAALENLNKALLADIEAHYQDPSLPYPKEDNTLLYEITAYLEAAGIHNPLNKIYITTKRLPYFPIVNFLFLIAQLPKLQYNKNLGMVCRKPTDPVDWPPLVLGLLTLLKQFHSRYTEQFLALIGQFICSTVEQCTSQKIPEIPADVVGALLFLEDYVRYTKLPRRVAEAHVPNFIFDEFRTVL

SEQ ID NO: 856 - protein, 439 aa, Homo sapiens
MPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 857 - protein, 324 aa, Homo sapiens
MGNLLKVLTCTDLEQGPNFFLDFENAQPTESEKEIYNQVNVVLKDAEGILEDLQSYRGAGHEIREAIQHPADEKLQEKAWGAVVPLVGKLKKFYEFSQRLEAALRGLLGALTSTPYSPTQHLEREQALAKQFAEILHFTLRFDELKMTNPAIQNDFSYYRRTLSRMRINNVPAEGENEVNNELANRMSLFYAEATPMLKTLSDATTKFVSENKNLPIENTTDCLSTMASVCRVMLETPEYRSRFTNEETVSFCLRVMVGVIILYDHVHPVGAFAKTSKIDMKGCIKVLKDQPPNSVEGLLNALRYTTKHLNDETTSKQIKSMLQ

SEQ ID NO: 858 - protein, 573 aa, Homo sapiens
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQVKSQHPLSWCCPIDPAGSCNQSMGSEDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSPPQPVNPPRPFKHSERRRRSQRLATLPMPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGISKTEKKVKLEDKSSTAFGIRSWDFSALLMKIPSYSPISLSGLPES

SEQ ID NO: 859 - protein, 150 aa, Homo sapiens
MFCVFPLEDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQV

SEQ ID NO: 860 - protein, 443 aa, Homo sapiens
MHIKAMPEDAKGQVKSQHPLSWCCPIDPAGSCNQSMGSEDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQAISPKPQSQKKNEADISSSANTQKPALLSSTLSSGKARSKKCKHESGDSSGCIKPPKSPLSPELIQVEDLTLVSQLSSSVINKTSPPQPVNPPRPFKHSERRRRSQRLATLPMPDDSVEKVSSPSPATDGKVFSISSQNQQESSVPEVPDVAHLPLEKLGPCLPLDLSRGSEVTAPVASDSSYRNECPRAEKEDTQMLPNPSSKAIADGRGAPAAAGISKTEKKVKLEDKSSTAFGIRSWDFSALLMKIPSYSPISLSGLPES

SEQ ID NO: 861 - protein, 285 aa, Homo sapiens
MSKKPPNRPGITFEIGARLEALDYLQKWYPSRIEKIDYEEGKMLVHFERWSHRYDEWIYWDSNRLRPLERPALRKEGLKDEEDFFDFKAGEEVLARWTDCRYYPAKIEAINKEGTFTVQFYDGVIRCLKRMHIKAMPEDAKGQDWIALVKAAAAAAAKNKTGSKPRTSANSNKDKDKDERKWFKVPSKKEETSTCIATPDVEKKEDLPTSSETFGLHVENVPKMVFPQPESTLSNKRKNNQGNSFQAKRARLNKITGLLASKAVGVDGAEKKEDYNETAPMLEQV

SEQ ID NO: 862 - protein, 394 aa, Homo sapiens
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 863 - protein, 1074 aa, Homo sapiens
MISADCNLCLPEYDRYLASSKIMAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 864 - protein, 1052 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 865 - protein, 208 aa, Homo sapiens
MLGLLVALLALGLAVFALLDVWYLVRLPCAVLRARLLQPRVRDLLAEQRFPGRVLPSDLDLLLHMNNARYLREADFARVAHLTRCGVLGALRELRAHTVLAASCARHRRSLRLLEPFEVRTRLLGWDDRAFYLEARFVSLRDGFVCALLRFRQHLLGTSPERVVQHLCQRRVEPPELPADLQHWISYNEASSQLLRMESGLSDVTKDQ

SEQ ID NO: 866 - protein, 948 aa, Homo sapiens
MEEKEMLRRQIRLLQGLIDDYKTLHGNAPAPGTPAASGWQPPTYHSGRAFSARYPRPSRRGYSSHHGPSWRKKYSLVNRPPGPSDPPADHAVRPLHGARGGRPPVPQQHVLERQVQLSQGQNVVIKVKPPSKSGSASASGAQRGSLEEFEETPWSDQRPREGEGKPPRGQLQPSRPTRARGTCSVEDPLLVCQKEPGKPRMVKSVGSVGDSPREPRRTVSESVIAVKASFASSALPPRTGVALGRKLGSHSVASCAPQLLGDRRVDAGHTDQPVPSGSVGGPARPASGPRQAREASLVVTCRTNKFRKNNYKWVAASSKSPRVARRALSPRVAAENVCKASAGMANKVEKPQLIADPEPKPRKPATSSKPGSAPSKYKWKASSPSASSSSSFRWQSEASSKDHASQLSPVLSRSPSGDRPAVGHSGLKPLSGETPLSAYKVKSRTKIIRRRGSTSLPGDKKSGTSPAATAKSHLSLRRRQALRGKSSPVLKKTPNKGLVQVTTHRLCRLPPSRAHLPTKEASSLHAVRTAPTSKVIKTRYRIVKKTPASPLSAPPFPLSLPSWRARRLSLSGSLVLNHLRPVASGGGKAQPGSPWWRSKGYRCIGGVLYKVSANKLSKTSGQPSDAGSRPLLRTGWLDPAGSCSRSLASRAVQRSLAIIRQARQRREKRKEYCMYYNRFGRCNRGERCPYIHDPEKVAVCTRFVRGTCKKTDGTCPFSHHVSKEKMRVCSYFLKGICSNSNCPYSHVYVSRKAEVCSDFLKGYCPLGAKCKKKHTLLCPDFARRGACPRGAQCQLLHRTQKRHSRRAATSPAPGPSDATARSRVSASHGPRKPSASQRPTRQTPSSAALTAAAVAAPPHCPGGSASPSSSKASSSSSSSSSPPASLDHEAPSLQEAALAAACSNRLCKLPSFISLQSSPSPGAQPRVRAPRAPLTKDSGKPLHIKPRL

SEQ ID NO: 867 - protein, 517 aa, Homo sapiens
MGDIQVLTLLPLPPARPESTMPDPFPLLRSMGSAFERVVRRVVQELDHGGEFIPVTSLQSSTGFQPYCLVVRKPSSSWFWKPRYKCVNLSIKDILEPDAAEPDVQRGRSFHFYDAMDGQIQGSVELAAPGQAKIAGGAAVSDSSSTSMNVYSLSVDPNTWQTLLHERWARRGQGRAGPHPPQATLLLFIYLFKLFFEVRFCYLGQGGLELLASSSPPASASQSAGITGVSHCARSQPCSWEGHNLGASGKSQRQKSAVAGTSLQEGSCRGHLGPPLPGLDPKDRTEPQAAVRTRGGVNTGAQVRGPHLESGLGVPESTFPHGVPSPWGAHGEAAGAPAPTDLWRAPLHHLPRWRGAVRGGKTPSGAAAQRALLLLGHRHLRQPEHKVLQQLRSRGDNVYVVTEVLQTQKEVEVTRTHKREGSGRFSLPGATCLQVCSQPRATPGPPRGHAAAGDGGGGLGSAKAPRSSSQPCAWLRSRSHLAAGLPPAPGPHPHPTARCQGPAPSPSPCLRVRARAI

SEQ ID NO: 868 - protein, 281 aa, Homo sapiens
MATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 869 - protein, 647 aa, Homo sapiens
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPDGSRRQGTPNTGQQVAVPDLAHQPSPPVNGQPPLGSLQALVREVWLEKPRYDAAERGFYEALFDGHPPGKVRLQERAGLAEGARRGRRDRRGRNILGNKRAGLRRADGEAPSALPYCYFLQKDAEAPWLSKPAYDSAECRHHAAEALRVAWCLEAASLSHRPGPRSGLSVSSLRPNRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 870 - protein, 321 aa, Homo sapiens
MGEPQGSMRILVTGGSGLVGKAIQKVVADGAGLPGEDWVFVSSKDADLTDTAQTRALFEKVQPTHVIHLAAMVGGLFRNIKYNLDFWRKNVHMNDNVLHSAFEVGARKVVSCLSTCIFPDKTTYPIDETMIHNGPPHNSNFGYSYAKRMIDVQNRAYFQQYGCTFTAVIPTNVFGPHDNFNIEDGHVLPGLIHKVHLAKSSGSALTVWGTGNPRRQFIYSLDLAQLFIWVLREYNEVEPIILSVGEEDEVSIKEAAEAVVEAMDFHGEVTFDTTKSDGQFKKTASNSKLRTYLPDFRFTPFKQAVKETCAWFTDNYEQARK

SEQ ID NO: 871 - protein, 321 aa, Homo sapiens; identical to SEQ ID NO: 870

SEQ ID NO: 872 - protein, 1630 aa, Homo sapiens
MLKCIPLWRCNRHVESVDKRHCSLQAVPEEIYRYSRSLEELLLDANQLRELPKPFFRLLNLRKLGLSDNEIQRLPPEVANFMQLVELDVSRNDIPEIPESIKFCKALEIADFSGNPLSRLPDGFTQLRSLAHLALNDVSLQALPGDVGNLANLVTLELRENLLKSLPASLSFLVKLEQLDLGGNDLEVLPDTLGALPNLRELWLDRNQLSALPPELGNLRRLVCLDVSENRLEELPAELGGLVLLTDLLLSQNLLRRLPDGIGQLKQLSILKVDQNRLCEVTEAIGDCENLSELILTENLLMALPRSLGKLTKLTNLNVDRNHLEALPPEIGGCVALSVLSLRDNRLAVLPPELAHTTELHVLDVAGNRLQSLPFALTHLNLKALWLAENQAQPMLRFQTEDDARTGEKVLTCYLLPQQPPLSLEDAGQQGSLSETWSDAPPSRVSVIQFLEAPIGDEDAEEAAAEKRGLQRRATPHPSELKVMKRSIEGRRSEACPCQPDSGSPLPAEEEKRLSAESGLSEDSRPSASTVSEAEPEGPSAEAQGGSQQEATTAGGEEDAEEDYQEPTVHFAEDALLPGDDREIEEGQPEAPWTLPGGRQRLIRKDTPHYKKHFKISKLPQPEAVVALLQGMQPDGEGPVAPGGWHNGPHAPWAPRAQKEEEEEEEGSPQEEEEEEEEENRAEEEEASTEEEDKEGAVVSAPSVKGVSFDQANNLLIEPARIEEEELTLTILRQTGGLGISIAGGKGSTPYKGDDEGIFISRVSEEGPAARAGVRVGDKLLEVNGVALQGAEHHEAVEALRGAGTAVQMRVWRERMVEPENAVTITPLRPEDDYSPRERRGGGLRLPLLPPESPGPLRQRHVACLARSERGLGFSIAGGKGSTPYRAGDAGIFVSRIAEGGAAHRAGTLQVGDRVLSINGVDVTEARHDHAVSLLTAASPTIALLLEREAGGPLPPSPLPHSSPPTAAVATTSITTATPGVPGLPSLAPSLLAAALEGPYPVEEIRLPRAGGPLGLSIVGGSDHSSHPFGVQEPGVFISKVLPRGLAARSGLRVGDRILAVNGQDVRDATHQEAVSALLRPCLELSLLVRRDPAPPGLRELCIQKAPGERLGISIRGGARGHAGNPRDPTDEGIFISKVSPTGAAGRDGRLRVGLRLLEVNQQSLLGLTHGEAVQLLRSVGDTLTVLVCDGFEASTDAALEVSPGVIANPFAAGIGHRNSLESISSIDRELSPEGPGKEKELPGQTLHWGPEATEAAGRGLQPLKLDYRALAAVPSAGSVQRVPSGAAGGKMAESPCSPSGQQPPSPPSPDELPANVKQAYRAFAAVPTSHPPEDAPAQPPTPGPAASPEQLSFRERQKYFELEVRVPQAEGPPKRVSLVGADDLRKMQEEEARKLQQKRAQMLREAAEAGAEARLALDGETLGEEEQEDEQPPWASPSPTSRQSPASPPPLGGGAPVRTAKAERRHQERLRVQSPEPPAPERALSPAELRALEAEKRALWRAARMKSLEQDALRAQMVLSRSQEGRGTRGPLERLAEAPSPAPTPSPTPVEDLGPQTSTSPGRLSPDFAEELRSLEPSPSPGPQEEDGEVALVLLGRPSPGAVGPEDVALCSSRRPVRPGRRGLGPVPS

SEQ ID NO: 873 - protein, 1655 aa, Homo sapiens
MLKCIPLWRCNRHVESVDKRHCSLQAVPEEIYRYSRSLEELLLDANQLRELPKPFFRLLNLRKLGLSDNEIQRLPPEVANFMQLVELDVSRNDIPEIPESIKFCKALEIADFSGNPLSRLPDGFTQLRSLAHLALNDVSLQALPGDVGNLANLVTLELRENLLKSLPASLSFLVKLEQLDLGGNDLEVLPDTLGALPNLRELWLDRNQLSALPPELGNLRRLVCLDVSENRLEELPAELGGLVLLTDLLLSQNLLRRLPDGIGQLKQLSILKVDQNRLCEVTEAIGDCENLSELILTENLLMALPRSLGKLTKLTNLNVDRNHLEALPPEIGGCVALSVLSLRDNRLAVLPPELAHTTELHVLDVAGNRLQSLPFALTHLNLKALWLAENQAQPMLRFQTEDDARTGEKVLTCYLLPQQPPLSLEDAGQQGSLSETWSDAPPSRVSVIQFLEAPIGDEDAEEAAAEKRGLQRRATPHPSELKVMKRSIEGRRSEACPCQPDSGSPLPAEEEKRLSAESGLSEDSRPSASTVSEAEPEGPSAEAQGGSQQEATTAGGEEDAEEDYQEPTVHFAEDALLPGDDREIEEGQPEAPWTLPGGRQRLIRKDTPHYKKHFKISKLPQPEAVVALLQGMQPDGEGPVAPGGWHNGPHAPWAPRAQKEEEEEEEGSPQEEEEEEEEENRAEEEEASTEEEDKEGAVVSAPSVKGVSFDQANNLLIEPARIEEEELTLTILRQTGGLGISIAGGKGSTPYKGDDEGIFISRVSEEGPAARAGVRVGDKLLEVNGVALQGAEHHEAVEALRGAGTAVQMRVWRERMVEPENAVTITPLRPEDDYSPRERRGGGLRLPLLPPESPGPLRQRHVACLARSERGLGFSIAGGKGSTPYRAGDAGIFVSRIAEGGAAHRAGTLQVGDRVLSINGVDVTEARHDHAVSLLTAASPTIALLLEREAGGPLPPSPLPHSSPPTAAVATTSITTATPGVPGLPSLAPSLLAAALEGPYPVEEIRLPRAGGPLGLSIVGGSDHSSHPFGVQEPGVFISKVLPRGLAARSGLRVGDRILAVNGQDVRDATHQEAVSALLRPCLELSLLVRRDPAPPGLRELCIQKAPGERLGISIRGGARGHAGNPRDPTDEGIFISKVSPTGAAGRDGRLRVGLRLLEVNQQSLLGLTHGEAVQLLRSVGDTLTVLVCDGFEASTDAALEVSPGVIANPFAAGIGHRNSLESISSIDRELSPEGPGKEKELPGQTLHWGPEATEAAGRGLQPLKLDYRALAAVPSAGSVQRVPSGAAGGKMAESPCSPSGQQPPSPPSPDELPANVKQAYRAFAAVPTSHPPEDAPAQPPTPGPAASPEQLSFRERQKYFELEVRVPQAEGPPKRVSLVGADDLRKMQEEEARKLQQKRAQMLREAAEAGAEARLALDGETLGEEEQEDEQPPWASPSPTSRQSPASPPPLGGGAPVRTAKAERRHQERLRVQSPEPPAPERALSPAELRALEAEKRALWRAARMKSLEQDALRAQMVLSRSQEGRGTRGPLERLAEAPSPAPTPSPTPVEDLGPQTSTSPGRLPLSGKKFDYRAFAALPSSRPVYDIQSPDFAEELRSLEPSPSPGPQEEDGEVALVLLGRPSPGAVGPEDVALCSSRRPVRPGRRGLGPVPS

SEQ ID NO: 874 - protein, 1364 aa, Homo sapiens
MSLLSSYEGLRQEIQRLAQENEELRRLVQLIQENQELKLVLRNRGSSLGFCSSGFLAEVAASPWLPRRRTIKFKNAERGLPAEELLWDSSPTTMGSPEGRFHFAIDRGGTFTDVFAQCPGGHVRVLKLLSEDPANYADAPTEGIRRILEQEAGMLLPRDQPLDSSHIASIRMGTTVATNALLERKGERVALLVTRGFRDLLHIGTQARGDLFDLAVPMPEVLYEEVLEVDERVVLHRGEAGTGTPVKGRTGDLLEVQQPVDLGALRGKLEGLLSRGIRSLAVVLMHSYTWAQHEQQVGVLARELGFTHVSLSSEAMPMVRIVPRGHTACADAYLTPAIQRYVQGFCRGFQGQLKDVQVLFMRSDGGLAPMDTFSGSSAVLSGPAGGVVGYSATTYQQEGGQPVIGFDMGGTSTDVSRYAGEFEHVFEASTAGVTLQAPQLDINTVAAGGGSRLFFRSGLFVVGPESAGAHPGPACYRKGGPVTVTDANLVLGRLLPASFPCIFGPGENQPLSPEASRKALEAVATEVNSFLTNGPCPASPLSLEEVAMGFVRVANEAMCRPIRALTQARGHDPSAHVLACFGGAGGQHACAIARALGMDTVHIHRHSGLLSALGLALADVVHEAQEPCSLLYAPETFVQLDQRLSRLEEQCVDALQAQGFPRSQISTESFLHLRYQGTDCALMVSAHQHPATARSPRAGDFGAAFVERYMREFGFVIPERPVVVDDVRVRGTGRSGLRLEDAPKAQTGPPRVDKMTQCYFEGGYQETPVYLLAELGYGHKLHGPCLIIDSNSTILVEPGCQAEVTKTGDICISVGAEVPGTVGPQLDPIQLSIFSHRFMSIAEQMGRILQRTAISTNIKERLDFSCALFGPDGGLVSNAPHIPVHLGAMQETVQFQIQHLGADLHPGDVLLSNHPSAGGSHLPDLTVITPVFWPGQTRPVFYVASRGHHADIGGITPGSMPPHSTMLQQEGAVFLSFKLVQGGVFQEEAVTEALRAPGKVPNCSGTRNLHDNLSDLRAQVAANQKGIQLVGELIGQYGLDVVQAYMGHIQANAELAVRDMLRAFGTSRQARGLPLEVSSEDHMDDGSPIRLRVQISLSQGSAVFDFSGTGPEVFGNLNAPRAVTLSALIYCLRCLVGRDIPLNQGCLAPVRVVIPRGSILDPSPEAAVVGGNVLTSQRVVDVILGAFGACAASQGCMNNVTLGNAHMGYYETVAGGAGAGPSWHGRSGVHSHMTNTRITDPEILESRGRFRGGDGVTRELLFREEALLSVLTERRAFRPYGLHGGEPGARGLNLLIRKNGRTVNLGGKTSVTVYPGDVFCLHTPGGGGYGDPEDPAPPPGSPPQALAFPEHGSVYEYRRAQEAV

SEQ ID NO: 875 - protein, 245 aa, Homo sapiens
MAGLELLSDQGYRVDGRRAGELRKIQARMGVFAQADGSAYIEQGNTKALAVVYGPHEIRGSRARALPDRALVNCQYSSATFSTGERKRRPHGDRKSCEMGLQLRQTFEAAILTQLHPRSQIDIYVQVLQADGGTYAACVNAATLAVLDAGIPMRDFVCACSAGFVDGTALADLSHVEEAAGGPQLALALLPASGQIALLEMDARLHEDHLERVLEAAAQAARDVHTLLDRVVRQHVREASILLGD

SEQ ID NO: 876 - protein, 245 aa, Homo sapiens; identical to SEQ ID NO: 875

SEQ ID NO: 877 - protein, 245 aa, Homo sapiens; identical to SEQ ID NO: 875

SEQ ID NO: 878 - protein, 621 aa, Homo sapiens
MGLLSDPVRRRALARLVLRLNAPLCVLSYVAGIAWFLALVFPPLTQRTYMSENAMGSTMVEEQFAGGDRARAFARDFAAHRKKSGALPVAWLERTMRSVGLEVYTQSFSRKLPFPDETHERYMVSGTNVYGILRAPRAASTESLVLTVPCGSDSTNSQAVGLLLALAAHFRGQIYWAKDIVFLVTEHDLLGTEAWLEAYHDVNVTGMQSSPLQGRAGAIQAAVALELSSDVVTSLDVAVEGLNGQLPNLDLLNLFQTFCQKGGLLCTLQGKLQPEDWTSLDGPLQGLQTLLLMVLRQASGRPHGSHGLFLRYRVEALTLRGINSFRQYKYDLVAVGKALEGMFRKLNHLLERLHQSFFLYLLPGLSRFVSIGLYMPAVGFLLLVLGLKALELWMQLHEAGMGLEEPGGAPGPSVPLPPSQGVGLASLVAPLLISQAMGLALYVLPVLGQHVATQHFPVAEAEAVVLTLLAIYAAGLALPHNTHRVVSTQAPDRGWMALKLVALIYLALQLGCIALTNFSLGFLLATTMVPTAALAKPHGPRTLYAALLVLTSPAATLLGSLFLWRELQEAPLSLAEGWQLFLAALAQGVLEHHTYGALLFPLLSLGLYPCWLLFWNVLFWK

SEQ ID NO: 879 - protein, 621 aa, Homo sapiens; identical to SEQ ID NO: 878

SEQ ID NO: 880 - protein, 621 aa, Homo sapiens; identical to SEQ ID NO: 878

SEQ ID NO: 881 - protein, 325 aa, Homo sapiens
MAAAAASLRGVVLGPRGAGLPGARARGLLCSARPGQLPLRTPQAVALSSKSGLSRGRKVMLSALGMLAAGGAGLAVALHSAVSASDLELHPPSYPWSHRGLLSSLDHTSIRRGFQVYKQVCASCHSMDFVAYRHLVGVCYTEDEAKELAAEVEVQDGPNEDGEMFMRPGKLFDYFPKPYPNSEAARAANNGALPPDLSYIVRARHGGEDYVFSLLTGYCEPPTGVSLREGLYFNPYFPGQAIAMAPPIYTDVLEFDDGTPATMSQIAKDVCTFLRWASEPEHDHRKRMGLKMLMMMALLVPLVYTIKRHKWSVLKSRKLAYRPPK

SEQ ID NO: 882 - protein, 410 aa, Homo sapiens
MAPPAGGAAAAASDLGSAAVLLAVHAAVRPLGAGPDAEAQLRRLQLSADPERPGRFRLELLGAGPGAVNLEWPLESVSYTIRGPTQHELQPPPGGPGTLSLHFLNPQEAQRWAVLVRGATVEGQNGSKSNSPPALGPEACPVSLPSPPEASTLKGPPPEADLPRSPGNLTEREELAGSLARAIAGGDEKGAAQVAAVLAQHRVALSVQLQEACFPPGPIRLQVTLEDAASAASAASSAHVALRVHPHCTVAALQEQVFSELGFPPAVQRWVIGRCLCVPERSLASYGVRQDGDPAFLYLLSAPREAPATGPSPQHPQKMDGELGRLFPPSLGLPQAPSQLPPACPVHSSPAGPVLPAPSSMPQTALAVRCVAPRGPALGTPLLQLPPSSHQRLQGESGPSLTSPTSPGPH

SEQ ID NO: 883 - protein, 390 aa, Homo sapiens
MGEAGAGAGASGGPEASPEAEVVKLLPFLAPGARADLQAAAVRHVLALTGCGPGRALLAGQAALLQALMELAPASAPARDAARALVNLAADPGLHETLLAADPGLPARLMGRALDPQWPWAEEAAAALANLSREPAPCAALMAALAAAEPADSGLERLVRALCTPGYNARAPLHYLAPLLSNLSQRPAARAFLLDPDRCVVQRLLPLTQYPDSSVRRGGVVGTLRNCCFEHRHHEWLLGPEVDILPFLLLPLAGPEDFSEEEMERLPVDLQYLPPDKQREPDADIRKMLVEAIMLLTATAPGRQQVRDQGAYLILRELHSWEPEPDVRTACEKLIQVLIGDEPERGMENLLEVQVPEDVEQQLQQLDCREQEQLERELAPEPWVERATPT

SEQ ID NO: 884 - protein, 488 aa, Homo sapiens
MGDRGSSRRRRTGSRPSSHGGGGPAAAEEEVRDAAAGPDVGAAGDAPAPAPNKDGDAGVGSGHWELRCHRLQDSLFSSDSGFSNYRGILNWCVVMLILSNARLFLENLIKYGILVDPIQVVSLFLKDPHSWPAPCLVIAANVFAVAAFQVEKRLAVGALTEQAGLLLHVANLATILCFPAAVVLLVESITPVGSLLALMAHTILFLKLFSYRDVNSWCRRARAKAASAGKKASSAAAPHTVSYPDNLTYRDLYYFLFAPTLCYELNFPRSPRIRKRFLLRRILEMLFFTQLQVGLIQQWMVPTIQNSMKPFKDMDYSRIIERLLKLAVPNHLIWLIFFYWLFHSCLNAVAELMQFGDREFYRDWWNSESVTYFWQNWNIPVHKWCIRHFYKPMLRRGSSKWMARTGVFLASAFFHEYLVSVPLRMFRLWAFTGMMAQIPLAWFVGRFFQGNYGNAAVWLSLIIGQPIAVLMYVHDYYVLNYEAPAAEA

SEQ ID NO: 885 - protein, 445 aa, Homo sapiens
MAAPTPARPVLTHLLVALFGMGSWAAVNGIWVELPVVVKELPEGWSLPSYVSVLVALGNLGLLVVTLWRRLAPGKDEQVPIRVVQVLGMVGTALLASLWHHVAPVAGQLHSVAFLALAFVLALACCASNVTFLPFLSHLPPRFLRSFFLGQGLSALLPCVLALVQGVGRLECPPAPINGTPGPPLDFLERFPASTFFWALTALLVASAAAFQGLLLLLPPPPSVPTGELGSGLQVGAPGAEEEVEESSPLQEPPSQAAGTTPGPDPKAYQLLSARSACLLGLLAATNALTNGVLPAVQSFSCLPYGRLAYHLAVVLGSAANPLACFLAMGVLCRSLAGLGGLSLLGVFCGGYLMALAVLSPCPPLVGTSAGVVLVVLSWVLCLGVFSYVKVAASSLLHGGGRPALLAAGVAIQVGSLLGAVAMFPPTSIYHVFHSRKDCADPCDS

SEQ ID NO: 886 - protein, 1442 aa, Homo sapiens
MYAVYKQAHPPPGLEFSMYCNFFNNSERNLVVAGTSQLYVYRLNRDAEALTKNDRSTEGKAHREKLELAASFSFFGNVMSMASVQLAGAKRDALLLSFKDAKLSVVEYDPGTHDLKTLSLHYFEEPELRDGFVQNVHTPRVRVDPDGRCAAMLVYGTRLVVLPFRRESLAEEHEGLVGEGQRSSFLPSYIIDVRALDEKLLNIIDLQFLHGYYEPTLLILFEPNQTWPGRVAVRQDTCSIVAISLNITQKVHPVIWSLTSLPFDCTQALAVPKPIGGVVVFAVNSLLYLNQSVPPYGVALNSLTTGTTAFPLRTQEGVRITLDCAQATFISYDKMVISLKGGEIYVLTLITDGMRSVRAFHFDKAAASVLTTSMVTMEPGYLFLGSRLGNSLLLKYTEKLQEPPASAVREAADKEEPPSKKKRVDATAGWSAAGKSVPQDEVDEIEVYGSEAQSGTQLATYSFEVCDSILNIGPCANAAVGEPAFLSEEFQNSPEPDLEIVVCSGHGKNGALSVLQKSIRPQVVTTFELPGCYDMWTVIAPVRKEEEDNPKGEGTEQEPSTTPEADDDGRRHGFLILSREDSTMILQTGQEIMELDTSGFATQGPTVFAGNIGDNRYIVQVSPLGIRLLEGVNQLHFIPVDLGAPIVQCAVADPYVVIMSAEGHVTMFLLKSDSYGGRHHRLALHKPPLHHQSKVITLCLYRDLSGMFTTESRLGGARDELGGRSGPEAEGLGSETSPTVDDEEEMLYGDSGSLFSPSKEEARRSSQPPADRDPAPFRAEPTHWCLLVRENGTMEIYQLPDWRLVFLVKNFPVGQRVLVDSSFGQPTTQGEARREEATRQGELPLVKEVLLVALGSRQSRPYLLVHVDQELLIYEAFPHDSQLGQGNLKVRFKKVPHNINFREKKPKPSKKKAEGGGAEEGAGARGRVARFRYFEDIYGYSGVFICGPSPHWLLVTGRGALRLHPMAIDGPVDSFAPFHNVNCPRGFLYFNRQGELRISVLPAYLSYDAPWPVRKIPLRCTAHYVAYHVESKVYAVATSTNTPCARIPRMTGEEKEFETIERDERYIHPQQEAFSIQLISPVSWEAIPNARIELQEWEHVTCMKTVSLRSEETVSGLKGYVAAGTCLMQGEEVTCRGRILIMDVIEVVPEPGQPLTKNKFKVLYEKEQKGPVTALCHCNGHLVSAIGQKIFLWSLRASELTGMAFIDTQLYIHQMISVKNFILAADVMKSISLLRYQEESKTLSLVSRDAKPLEVYSVDFMVDNAQLGFLVSDRDRNLMVYMYLPEAKESFGGMRLLRRADFHVGAHVNTFWRTPCRATEGLSKKSVVWENKHITWFATLDGGIGLLLPMQEKTYRRLLMLQNALTTMLPHHAGLNPRAFRMLHVDRRTLQNAVRNVLDGELLNRYLYLSTMERSELAKKIGTTPDIILDDLLETDRVTAHF

SEQ ID NO: 887 - protein, 626 aa, Homo sapiens
MVDVVGLERETGPRGSPWPGLPLPSLVGPAPLLTCLCPQCLSVEDALGLGEPEGSGLPPGPVLEARYVARLSAAAVLYLSNPEGTCEDARAGLWASHADHLLALLESPKALTPGLSWLLQRMQARAAGQTPKTACVDIPQLLEEAVGAGAPGSAGGVLAALLDHVRSGSCFHALPSPQYFVDFVFQQHSSEVPMTLAELSALMQRLGVGREAHSDHSHRHRGASSRDPVPLISSSNSSSVWDTVCLSARDVMAAYGLSEQAGVTPEAWAQLSPALLQQQLSGAYTSQSRPPVQDQLSQSERYLYGSLATLLICLCAVFGLLLLTCTGCRGVAHYILQTFLSLAVGALTGDAVLHLTPKVLGLHTHSEEGLSPQPTWRLLAMLAGLYAFFLFENLFNLLLPRDPEDLEDGPCGHSSHSHGGHSHGVSLQLAPSELRQPKPPHEGSRADLVAEESPELLNPEPRRLSPELRLLPYMITLGDAVHNFADGLAVGAAFASSWKTGLATSLAVFCHELPHELGDFAALLHAGLSVRQALLLNLASALTAFAGLTWHSRLESARRARPGSWQWPPACSLRSTLRHAPGDVESTGPAAPGSSSCCTTWACWAAGPSCCCCPCTRMTSPSDTLP

SEQ ID NO: 888 - protein, 647 aa, Homo sapiens
MASLVSLELGLLLAVLVVTATASPPAGLLSLLTSGQGALDQEALGGLLNTLADRVHCTNGPCGKCLSVEDALGLGEPEGSGLPPGPVLEARYVARLSAAAVLYLSNPEGTCEDTRAGLWASHADHLLALLESPKALTPGLSWLLQRMQARAAGQTPKTACVDIPQLLEEAVGAGAPGSAGGVLAALLDHVRSGSCFHALPSPQYFVDFVFQQHSSEVPMTLAELSALMQRLGVGREAHSDHSHRHRGASSRDPVPLISSSNSSSVWDTVCLSARDVMAAYGLSEQAGVTPEAWAQLSPALLQQQLSGACTSQSRPPVQDQLSQSERYLYGSLATLLICLCAVFGLLLLTCTGCRGVAHYILQTFLSLAVGALTGDAVLHLTPKVLGLHTHSEEGLSPQPTWRLLAMLAGLYAFFLFENLFNLLLPRDPEDLEDGPCGHSSHSHGGHSHGVSLQLAPSELRQPKPPHEGSRADLVAEESPELLNPEPRRLSPELRLLPYMITLGDAVHNFADGLAVGAAFASSWKTGLATSLAVFCHELPHELGDFAALLHAGLSVRQALLLNLASALTAFAGLYVALAVGVSEESEAWILAVATGLFLYVALCDMLPAMLKVRDPRPWLLFLLHNVGLLGGWTVLLLLSLYEDDITF

SEQ ID NO: 889 - protein, 221 aa, Homo sapiens
MFHGIPATPGIGAPGNKPELYEEVKLYKNAREREKYDNMAELFAVVKTMQALEKAYIKDCVSPSEYTAACSRLLVQYKAAFRQVQGSEISSIDEFCRKFRLDCPLAMERIKEDRPITIKDDKGNLNRCIADVVSLFITVMDKLRLEIRAMDEIQPDLRELMETMHRMSHLPPDFEGRQTVSQWLQTLSGMSASDELDDSQVRQMLFDLESAYNAFNRFLHA

SEQ ID NO: 890 - protein, 233 aa, Homo sapiens
MFHGIPATPGIGAPGNKPELYEEVKLYKNAREREKYDNMAELFAVVKTMQALEKAYIKDCVSPSEYTAACSRLLVQYKAAFRQVQGSEISSIDEFCRKFRLDCPLAMERIKEDRPITIKDDKGNLNRCIADVVSLFITVMDKLRLEIRAMDEIQPDLRELMETMHRMSHLPPDFEGRQTVSQWWVSLPARQSPAVPETLPARRSPAVPLRPSAPTCPVLHSQAADPERHVGVR

SEQ ID NO: 891 - protein, 284 aa, Homo sapiens
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESKCGDLEEELKIVTNNLKSLEAQADKYSTKEDKYEEEIKLLEEKLKEAETRAEFAERSVAKLEKTIDDLEDEVYAQKMKYKAISEELDNALNDITSL

SEQ ID NO: 892 - protein, 2541 aa, Homo sapiens
MVALSLKISIGNVVKTMQFEPSTMVYDACRIIRERIPEAPAGPPSDFGLFLSDDDPKKGIWLEAGKALDYYMLRNGDTMEYRKKQRPLKIRMLDGTVKTIMVDDSKTVTDMLMTICARIGITNHDEYSLVRELMEEKKEEITGTLRKDKTLLRDEKKMEKLKQKLHTDDELNWLDHGRTLREQGVEEHETLLLRRKFFYSDQNVDSRDPVQLNLLYVQARDDILNGSHPVSFDKACEFAGFQCQIQFGPHNEQKHKAGFLDLKDFLPKEYVKQKGERKIFQAHKNCGQMSEIEAKVRYVKLARSLKTYGVSFFLVKEKMKGKNKLVPRLLGITKECVMRVDEKTKEVIQEWNLTNIKRWAASPKSFTLDFGDYQDGYYSVQTTEGEQIAQLIAGYIDIILKKKKSKDHFGLEGDEESTMLEDSVSPKKSTVLQQQYNRVGKVEHGSVALPAIMRSGASGPENFQVGSMPPAQQQITSGQMHRGHMPPLTSAQQALTGTINSSMQAVQAAQATLDDFDTLPPLGQDAASKAWRKNKMDESKHEIHSQVDAITAGTASVVNLTAGDPAETDYTAVGCAVTTISSNLTEMSRGVKLLAALLEDEGGSGRPLLQAAKGLAGAVSELLRSAQPASAEPRQNLLQAAGNVGQASGELLQQIGESDTDPHFQDALMQLAKAVASAAAALVLKAKSVAQRTEDSGLQTQVIAAATQCALSTSQLVACTKVVAPTISSPVCQEQLVEAGRLVAKAVEGCVSASQAATEDGQLLRGVGAAATAVTQALNELLQHVKAHATGAGPAGRYDQATDTILTVTENIFSSMGDAGEMVGQARILAQATSDLVNAIKADAEGESDLENSRKLLSAAKILADATAKMVEAAKGAAAHPDSEEQQQRLREAAEGLRMATNAAAQNAIKKKLVQRLEHAAKQAAASATQTIAAAQHAASTPKASAGPQPLLVQSCKAVAEQIPLLVQGVRGSQAQPDSPSAQLALIAASQSFLQPGGKMVAAAKASVPTIQDQASAMQLSQCAKNLGTALAELRTAAQKAQEACGPLEMDSALSVVQNLEKDLQEVKAAARDGKLKPLPGETMEKCTQDLGNSTKAVSSAIAQLLGEVAQGNENYAGIAARDVAGGLRSLAQAARGVAALTSDPAVQAIVLDTASDVLDKASSLIEEAKKAAGHPGDPESQQRLAQVAKAVTQALNRCVSCLPGQRDVDNALRAVGDASKRLLSDSLPPSTGTFQEAQSRLNEAAAGLNQAATELVQASRGTPQDLARASGRFGQDFSTFLEAGVEMAGQAPSQEDRAQVVSNLKGISMSSSKLLLAAKALSTDPAAPNLKSQLAAAARAVTDSINQLITMCTQQAPGQKECDNALRELETVRELLENPVQPINDMSYFGCLDSVMENSKVLGEAMTGISQNAKNGNLPEFGDAISTASKALCGFTEAAAQAAYLVGVSDPNSQAGQQGLVEPTQFARANQAIQMACQSLGEPGCTQAQVLSAATIVAKHTSALCNSCRLASARTTNPTAKRQFVQSAKEVANSTANLVKTIKALDGAFTEENRAQCRAATAPLLEAVDNLSAFASNPEFSSIPAQISPEGRAAMEPIVISAKTMLESAGGLIQTARALAVNPRDPPSWSVLAGHSRTVSDSIKKLITSMRDKAPGQLECETAIAALNSCLRDLDQASLAAVSQQLAPREGISQEALHTQMLTAVQEISHLIEPLANAARAEASQLGHKVSQMAQYFEPLTLAAVGAASKTLSHPQQMALLDQTKTLAESALQLLYTAKEAGGNPKQAAHTQEALEEAVQMMTEAVEDLTTTLNEAASAAGVVGGMVDSITQAINQLDEGPMGEPEGSFVDYQTTMVRTAKAIAVTVQEMVTKSNTSPEELGPLANQLTSDYGRLASEAKPAAVAAENEEIGSHIKHRVQELGHGCAALVTKAGALQCSPSDAYTKKELIECARRVSEKVSHVLAALQAGNRGTQACITAASAVSGIIADLDTTIMFATAGTLNREGTETFADHREGILKTAKVLVEDTKVLVQNAAGSQEKLAQAAQSSVATITRLADVVKLGAASLGAEDPETQVVLINAVKDVAKALGDLISATKAAAGKVGDDPAVWQLKNSAKVMVTNVTSLLKTVKAVEDEATKGTRALEATTEHIRQELAVFCSPEPPAKTSTPEDFIRMTKGITMATAKAVAAGNSCRQEDVIATANLSRRAIADMLRACKEAAYHPEVAPDVRLRALHYGRECANGYLELLDHVLLTLQKPSPELKQQLTGHSKRVAGSVTELIQAAEAMKGTEWVDPEDPTVIAENELLGAAAAIEAAAKKLEQLKPRAKPKEADESLNFEEQILEAAKSIAAATSALVKAASAAQRELVAQGKVGAIPANALDDGQWSQGLISAARMVAAATNNLCEAANAAVQGHASQEKLISSAKQVAASTAQLLVACKVKADQDSEAMKRLQAAGNAVKRASDNLVKAAQKAAAFEEQENETVVVKEKMVGGIAQIIAAQEEMLRKERELEEARKKLAQIRQQQYKFLPSELRDEH

SEQ ID NO: 893 - protein, 371 aa, Homo sapiens
MELELDAGDQDLLAFLLEESGDLGTAPDEAVRAPLDWALPLSEVPSDWEVDDLLCSLLSPPASLNILSSSNPCLVHHDHTYSLPRETVSMDLESESCRKEGTQMTPQHMEELAEQEIARLVLTDEEKSLLEKEGLILPETLPLTKTEEQILKRVRRKIRNKRSAQESRRKKKVYVGGLESRVLKYTAQNMELQNKVQLLEEQNLSLLDQLRKLQAMVIEISNKTSSSSTCILVLLVSFCLLLVPAMYSSDTRGSLPAEHGVLSRQLRALPSEDPYQLELPALQSEVPKDSTHQWLDGSDCVLQAPGNTSCLLHYMPQAPSAEPPLEWPFPDLFSEPLCRGPILPLQANLTRKGGWLPTGSPSVILQDRYSG

SEQ ID NO: 894 - protein, 371 aa, Homo sapiens; identical to SEQ ID NO: 893

SEQ ID NO: 895 - protein, 2042 aa, Homo sapiens
MALPSLLLLVAALAGGVRPPGARNLTLAVVLPEHNLSYAWAWPRVGPAVALAVEALGRALPVDLRFVSSELEGACSEYLAPLSAVDLKLYHDPDLLLGPGCVYPAASVARFASHWRLPLLTAGAVASGFSAKNDHYRTLVRTGPSAPKLGEFVVTLHGHFNWTARAALLYLDARTDDRPHYFTIEGVFEALQGSNLSVQHQVYAREPGGPEQATHFIRANGRIVYICGPLEMLHEILLQAQRENLTNGDYVFFYLDVFGESLRAGPTRATGRPWQDNRTREQAQALREAFQTVLVITYREPPNPEYQEFQNRLLIRAREDFGVELGPSLMNLIAGCFYDGILLYAEVLNETIQEGGTREDGLRIVEKMQGRRYHGVTGLVVMDKNNDRETDFVLWAMGDLDSGDFQPAAHYSGAEKQIWWTGRPIPWVKGAPPSDNPPCAFDLDDPSCDKTPLSTLAIVALGTGITFIMFGVSSFLIFRKLMLEKELASMLWRIRWEELQFGNSERYHKGAGSRLTLSLRGSSYGSLMTAHGKYQIFANTGHFKGNVVAIKHVNKKRIELTRQVLFELKHMRDVQFNHLTRFIGACIDPPNICIVTEYCPRGSLQDILENDSINLDWMFRYSLINDLVKGMAFLHNSIISSHGSLKSSNCVVDSRFVLKITDYGLASFRSTAEPDDSHALYAKKLWTAPELLSGNPLPTTGMQKADVYSFGIILQEIALRSGPFYLEGLDLSPKEIVQKVRNGQRPYFRPSIDRTQLNEELVLLMERCWAQDPAERPDFGQIKGFIRRFNKEGGTSILDNLLLRMEQYANNLEKLVEERTQAYLEEKRKAEALLYQILPHSVAEQLKRGETVQAEAFDSVTIYFSDIVGFTALSAESTPMQVVTLLNDLYTCFDAIIDNFDVYKVETIGDAYMVVSGLPGRNGQRHAPEIARMALALLDAVSSFRIRHRPHDQLRLRIGVHTGKADSHSSPSLHLSQTLPTCFFSKGQSVLGLLAMALPSLLLLVAALAGGVRPPGARNLTLAVVLPEHNLSYAWAWPRVGPAVALAVEALGRALPVDLRFVSSELEGACSEYLAPLSAVDLKLYHDPDLLLGPGCVYPAASVARFASHWRLPLLTAGAVASGFSAKNDHYRTLVRTGPSAPKLGEFVVTLHGHFNWTARAALLYLDARTDDRPHYFTIEGVFEALQGSNLSVQHQVYAREPGGPEQATHFIRANGRIVYICGPLEMLHEILLQAQRENLTNGDYVFFYLDVFGESLRAGPTRATGRPWQDNRTREQAQALREAFQTVLVITYREPPNPEYQEFQNRLLIRAREDFGVELGPSLMNLIAGCFYDGILLYAEVLNETIQEGGTREDGLRIVEKMQGRRYHGVTGLVVMDKNNDRETDFVLWAMGDLDSGDFQPAAHYSGAEKQIWWTGRPIPWVKGAPPSDNPPCAFDLDDPSCDKTPLSTLAIVALGTGITFIMFGVSSFLIFRKLMLEKELASMLWRIRWEELQFGNSERYHKGAGSRLTLSLRGSSYGSLMTAHGKYQIFANTGHFKGNVVAIKHVNKKRIELTRQVLFELKHMRDVQFNHLTRFIGACIDPPNICIVTEYCPRGSLQDILENDSINLDWMFRYSLINDLVKGMAFLHNSIISSHGSLKSSNCVVDSRFVLKITDYGLASFRSTAEPDDSHALYAKKLWTAPELLSGNPLPTTGMQKADVYSFGIILQEIALRSGPFYLEGLDLSPKEIVQKVRNGQRPYFRPSIDRTQLNEELVLLMERCWAQDPAERPDFGQIKGFIRRFNKEGGTSILDNLLLRMEQYANNLEKLVEERTQAYLEEKRKAEALLYQILPHSVAEQLKRGETVQAEAFDSVTIYFSDIVGFTALSAESTPMQVVTLLNDLYTCFDAIIDNFDVYKVETIGDAYMVVSGLPGRNGQRHAPEIARMALALLDAVSSFRIRHRPHDQLRLRIGVHTGPVCAGVVGLKMPRYCLFGDTVNTASRMESNGQALKIHVSSTTKDALDELGCFQLELRGDVEMKGKGKMRTYWLLGERKGPPGLL

SEQ ID NO: 896 - protein, 338 aa, Homo sapiens
MNMPQSLGNQPLPPEPPSLGTPAEGPGTTSPPEHCWPVRPTLRNELDTFSVHFYIFFGPSVALPPERPAVFAMRLLPVLDSGGVLSLELQLNASSVRQENVTVFGCLTHEVPLSLGDAAVTCSKESLAGFLLSVSATTRVARLRIPFPQTGTWFLALRSLCGVGPRFVRCRNATAEVRMRTFLSPCVDDCGPYGQCKLLRTHNYLYAACECKAGWRGWGCTDSADALTYGFQLLSTLLLCLSNLMFLPPVVLAIRSRYVLEAAVYTFTMFFSTVCGGVCILSLGACAWWWVTVCISTTFSEGLGMSVPSLCLLQTETAVLPKLSCIDNGHFCKTHWSK

SEQ ID NO: 897 - protein, 218 aa, Homo sapiens
MAELDPFGAPAGAPGGPALGNGVAGAGEEDPAAAFLAQQESEIAGIENDEAFAILDGGAPGPQPHGEPPGGPDAVDGVMNGEYYQESNGPTDSYAAISQVDRLQSEPESIRKWREEQMERLEALDANSRKQEAEWKEKAIKELEEWYARQDEQLQKTKANNRAAEEAFVNDIDESSPGTEWERVARLCDFNPKSSKQAKDVSRMRSVLISLKQAPLVH

SEQ ID NO: 898 - protein, 248 aa, Homo sapiens
MAELDPFGAPAGAPGGPALGNGVAGAGEEDPAAAFLAQQESEIAGIENDEAFAILDGGAPGPQPHGEPPGGPDAVDGVMNGEYYQESNGPTDSYAAISQVDRLQSEPESIRKWREEQMERLEALDANSRKQEAEWKEKAIKELEEWYARQDEQLQKTKANNRVADEAFYKQPFADVIGYVTNINHPCYSLEQAAEEAFVNDIDESSPGTEWERVARLCDFNPKSSKQAKDVSRMRSVLISLKQAPLVH

SEQ ID NO: 899 - protein, 218 aa, Homo sapiens; identical to SEQ ID NO: 897

SEQ ID NO: 900 - protein, 248 aa, Homo sapiens; identical to SEQ ID NO: 898

SEQ ID NO: 901 - protein, 515 aa, Homo sapiens
MACKISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 902 - protein, 432 aa, Homo sapiens
MRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 903 - protein, 465 aa, Homo sapiens
MACKSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 904 - protein, 432 aa, Homo sapiens; identical to SEQ ID NO: 902

SEQ ID NO: 905 - protein, 414 aa, Homo sapiens
MRPWEMTSNRQPPSVRPSQHHFSGERCNTPARNRRSPPVRRQRGRRDRLSRHNSISQDAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLPVGGFTYPPSAHPPTLPPSAPLQFLTHDPLHQEVSFGVPYPPFMPRRLTGRSRYRSQQPIPPPPYHPSLLPYVLSMLPVPPAVGPTFSFELDVEDGEVENYEALLNLAERLGEAKPRGLTKADIEQLPSYRFNPNNHQSEQTLCVVCMCDFESRQLLRVLPCNHEFHAKCVDKWLKANRTCPICRADASEVHRDSE

SEQ ID NO: 906 - protein, 432 aa, Homo sapiens; identical to SEQ ID NO: 902

SEQ ID NO: 907 - protein, 434 aa, Homo sapiens
MDSVEKGAATSVSNPRGRPSRGRPPKLQRNSRGGQGRGVEKPPHLAALILARGGSKGIPLKNIKHLAGVPLIGWVLRAALDSGAFQSVWVSTDHDEIENVAKQFGAQVHRRSSEVSKDSSTSLDAIIEFLNYHNEVDIVGNIQATSPCLHPTDLQKVAEMIREEGYDSVFSVVRRHQFRWSEIQKGVREVTEPLNLNPAKRPRRQDWDGELYENGSFYFAKRHLIEMGYLQGGKMAYYEMRAEHSVDIDVDIDWPIAEQRVLRYGYFGKEKLKEIKLLVCNIDGCLTNGHIYVSGDQKEIISYDVKDAIGISLLKKSGIEVRLISERACSKQTLSSLKLDCKMEVSVSDKLAVVDEWRKEMGLCWKEVAYLGNEVSDEECLKRVGLSGAPADACSTAQKAVGYICKCNGGRGAIREFAEHICLLMEKVNNSCQK

SEQ ID NO: 908 - protein, 1724 aa, Homo sapiens
MVMGIFANCIFCLKVKYLPQQQKKKLQTDIKENGGKFSFSLNPQCTHIILDNADVLSQYQLNSIQKNHVHIANPDFIWKSIREKRLLDVKNYDPYKPLDITPPPDQKASSSEVKTEGLCPDSATEEEDTVELTEFGMQNVEIPHLPQDFEVAKYNTLEKVGMEGGQEAVVVELQCSRDSRDCPFLISSHFLLDDGMETRRQFAIKKTSEDASEYFENYIEELKKQGFLLREHFTPEATQLASEQLQALLLEEVMNSSTLSQEVSDLVEMIWAEALGHLEHMLLKPVNRISLNDVSKAEGILLLVKAALKNGETAEQLQKMMTEFYRLIPHKGTMPKEVNLGLLAKKADLCQLIRDMVNVCETNLSKPNPPSLAKYRALRCKIEHVEQNTEEFLRVRKEVLQNHHSKSPVDVLQIFRVGRVNETTEFLSKLGNVRPLLHGSPVQNIVGILCRGLLLPKVVEDRGVQRTDVGNLGSGIYFSDSLSTSIKYSHPGETDGTRLLLICDVALGKCMDLHEKDFSLTEAPPGYDSVHGVSQTASVTTDFEDDEFVVYKTNQVKMKYIIKFSMPGDQIKDFHPSDHTELEEYRPEFSNFSKVEDYQLPDAKTSSSTKAGLQDASGNLVPLEDVHIKGRIIDTVAQVIVFQTYTNKSHVPIEAKYIFPLDDKAAVCGFEAFINGKHIVGEIKEKEEAQQEYLEAVTQGHGAYLMSQDAPDVFTVSVGNLPPKAKVLIKITYITELSILGTVGVFFMPATVAPWQQDKALNENLQDTVEKICIKEIGTKQSFSLTMSIEMPYVIEFIFSDTHELKQKRTDCKAVISTMEGSSLDSSGFSLHIGLSAAYLPRMWVEKHPEKESEACMLVFQPDLDVDLPDLANESEVIICLDCSSSMEGVTFLQAKEIALHALSLVGEKQKVNIIQFGTGYKELFSYPKHITSNTAAAEFIMSATPTMGNTDFWKTLRYLSLLYPARGSRNILLVSDGHLQDESLTLQLVKRSRPHTRLFACGIGSTANRHVLRILSQCGAGVFEYFNAKSKHSWRKQIEDQMTRLCSPSCHSVSVKWQQLNPDAPEALQAPAQVPSLFRNDRLLVYGFIPHCTQATLCALIQEKEFCTMVSTTELQKTTGTMIHKLAARALIRDYEDGILHENETSHEMKKQTLKSLIIKLSKENSLITQFTSFVAVEKRDENESPFPDIPKVSELIAKEDVDFLPYMSWQGEPQEAVRNQSLLASSEWPELRLSKRKHRKIPFSKRKMELSQPEVSEDFEEDALGVLPAFTSNLERGRVEKLLDLSWTESCKPTATEPLFKKVSPWETSTSSFFPILAPAVGSYLTPTTRAHSPASLSFASYRQVASFGSAAPPRQFDASQFSQGPVPGTCADWIPQSASCPTGPPQNPPSAPYCGIVFSGSSLSSAQSAPLQHPGGFTTRPSAGTFPELDSPQLHFSLPTDPDPIRGFGSYHPSAYSPFHFQPSAASLTANLRLPMASALPEALCSQSRTTPVDLCLLEESVGSLEGSRCPVFAFQSSDTESDELSEVLQDSCFLQIKCDTKDDSIPCFLEVKEEDEIVCTQHWQDAVPWTELLSLQTEDGFWKLTPELGLILNLNTNGLHSFLKQKGIQSLGVKGRECLLDLIATMLVLQFIRTRLEKEGIVFKSLMKMDDPSISRNIPWAFEAIKQASEWVRRTEGQYPSICPRLELGNDWDSATKQLLGLQPISTVSPLHRVLHYSQG

SEQ ID NO: 909 - protein, 621 aa, Homo sapiens
MEHIRTTKVEQVKLLDRFSTSNKSLTGTLYLTATHLLFIDSHQKETWILHHHIASVEKLALTTSGCPLVIQCKNFRTVHFIVPRERDCHDIYNSLLQLSKQAKYEDLYAFSYNPKQNDSERLQGWQLIDLAEEYKRMGVPNSHWQLSDANRDYKICETYPRELYVPRIASKPIIVGSSKFRSKGRFPVLSYYHQDKEAAICRCSQPLSGFSARCLEDEHLLQAISKANPVNRYMYVMDTRPKLNAMANRAAGKGYENEDNYSNIRFQFVGIENIHVMRSSLQKLLEVNGTKGLSVNDFYSGLESSGWLRHIKAVMDAAVFLAKAITVENASVLVHCSDGWDRTSQVCSLGSLLLDSYYRTIKGFMVLIEKDWISFGHKFSERCGQLDGDPKEVSPVFTQFLECVWHLTEQFPQAFEFSEAFLLQIHEHIHSCQFGNFLGNCQKEREELKLKEKTYSLWPFLLEDQKKYLNPLYSSESHRFTVLEPNTVSFNFKFWRNMYHQFDRTLHPRQSVFNIIMNMNEQNKQLEKDIKDLESKIKQRKNKQTDGILTKELLHSVHPESPNLKTSLCFKEQTLLPVNDALRTIEGSSPADNRYSEYAEEFSKSEPAVVSLEYGVARMTC

SEQ ID NO: 910 - protein, 685 aa, Homo sapiens [sequence omitted]

SEQ ID NO: 911 - protein, 685 aa, Homo sapiens [sequence omitted]

SEQ ID NO: 912 - protein, 685 aa, Homo sapiens [sequence omitted]

SEQ ID NO: 913 - protein, 142 aa, Homo sapiens
MNQSRSRSDGGSEETLPQDHNHHENERRWQQERLHREEAYYQFINELNDEDYRLMRDHNLLGTPGEITSEELQQRLDGVKEQLASQPDLRDGTNYRDSEVPRESSHEDSLLEWLNTFRRTGNATRSGQNGNQTWRAALPDTS

SEQ ID NO: 914 - protein, 476 aa, Homo sapiens
MRSEKEGAGGLRAAVAARGPSGREKLSALEVQFHRDSQQQEAETPPTSSSGCGGGAGKPREEKRTALSKVVIRRLPPGLTKEQLEEQLRPLPAHDYFEFFAADLSLYPHLYSRAYINFRNPDDILLFRDRFDGYIFLDSKGLEYPAVVEFAPFQKIAKKKLRKKDAKTGSIEDDPEYKKFLETYCVEEEKTSANPETLLGEMEAKTRELIARRTTPLLEYIKNRKLEKQRIREEKREERRRRELEKKRLREEEKRRRREEERCKKKETDKQKKIAEKEVRIKLLKKPEKGEEPTTEKPKERGEEIDTGGGKQESCAPGAVVKARPMEGSLEEPQETSHSGSDKEHRDVERSQEQESEAQRYHVDDGRRHRAHHEPERLSRRSEDEQRWGKGPGQDRGKKGSQDSGAPGEAMERLGRAQRCDDSPAPRKERLANKDRPALQLYDPGARFRARECGGNRRICKAEGSGTGPEKREEAE

SEQ ID NO: 915 - protein, 443 aa, Homo sapiens
MRSEKEGAGGLRAAVAARGPSGREKLSALEVQFHRDSQQQEAETPPTSSSGCGGGAGKPREEKRTALSKVVIRRLPPGLTKEQLEEQLRPLPAHDYFEFFAADLSLYPHLYSRAYINFRNPDDILLFRDRFDGYIFLDSKDPEYKKFLETYCVEEEKTSANPETLLGEMEAKTRELIARRTTPLLEYIKNRKLEKQRIREEKREERRRRELEKKRLREEEKRRRREEERCKKKETDKQKKIAEKEVRIKLLKKPEKGEEPTTEKPKERGEEIDTGGGKQESCAPGAVVKARPMEGSLEEPQETSHSGSDKEHRDVERSQEQESEAQRYHVDDGRRHRAHHEPERLSRRSEDEQRWGKGPGQDRGKKGSQDSGAPGEAMERLGRAQRCDDSPAPRKERLANKDRPALQLYDPGARFRARECGGNRRICKAEGSGTGPEKREEAE

SEQ ID NO: 916 - protein, 642 aa, Homo sapiens
MAAAAAATAAAAASIRERQTVALKRMLNFNVPHIKNSTGEPVWKVLIYDRFGQDIISPLLSVKELRDMGITLHLLLHSDRDPIPDVPAVYFVMPTEENIDRMCQDLRNQLYESYYLNFISAISRSKLEDIANAALAASAVTQVAKVFDQYLNFITLEDDMFVLCNQNKELVSYRAINRPDITDTEMETVMDTIVDSLFCFFVTLGAVPIIRCSRGTAAEMVAVKLDKKLRENLRDARNSLFTGDTLGAGQFSFQRPLLVLVDRNIDLATPLHHTWTYQALVHDVLDFHLNRVNLEESSGVENSPAGARPKRKNKKSYDLTPVDKFWQKHKGSPFPEVAESVQQELESYRAQEDEVKRLKSIMGLEGEDEGAISMLSDNTAKLTSAVSSLPELLEKKRLIDLHTNVATAVLEHIKARKLDVYFEYEEKIMSKTTLDKSLLDIISDPDAGTPEDKMRLFLIYYISTQQAPSEADLEQYKKALTDAGCNLNPLQYIKQWKAFTKMASAPASYGSTTTKPMGLLSRVMNTGSQFVMEGVKNLVLKQQNLPVTRILDNLMEMKSNPETDDYRYFDPKMLRGNDSSVPRNKNPFQEAIVFVVGGGNYIEYQNLVDYIKGKQGKHILYGCSELFNATQFIKQLSQLGQK

SEQ ID NO: 917 - protein, 575 aa, Homo sapiens
MGITLHLLLHSDRDPIPDVPAVYFVMPTEENIDRMCQDLRNQLYESYYLNFISAISRSKLEDIANAALAASAVTQVAKVFDQYLNFITLEDDMFVLCNQNKELVSYRAINRPDITDTEMETVMDTIVDSLFCFFVTLGAVPIIRCSRGTAAEMVAVKLDKKLRENLRDARNSLFTGDTLGAGQFSFQRPLLVLVDRNIDLATPLHHTWTYQALVHDVLDFHLNRVNLEESSGVENSPAGARPKRKNKKSYDLTPVDKFWQKHKGSPFPEVAESVQQELESYRAQEDEVKRLKSIMGLEGEDEGAISMLSDNTAKLTSAVSSLPELLEKKRLIDLHTNVATAVLEHIKARKLDVYFEYEEKIMSKTTLDKSLLDIISDPDAGTPEDKMRLFLIYYISTQQAPSEADLEQYKKALTDAGCNLNPLQYIKQWKAFTKMASAPASYGSTTTKPMGLLSRVMNTGSQFVMEGVKNLVLKQQNLPVTRILDNLMEMKSNPETDDYRYFDPKMLRGNDSSVPRNKNPFQEAIVFVVGGGNYIEYQNLVDYIKGKQGKHILYGCSELFNATQFIKQLSQLGQK

SEQ ID NO: 918 - protein, 159 aa, Homo sapiens
MIKFFLMVNKQGQTRLSKYYEHVDINKRTLLETEVIKSCLSRSNEQCSFIEYKDFKLIYRQYAALFIVVGVNDTENEMAIYEFIHNFVEVLDEYFSRVSELDVSFFNTVFHSTWQMHSGPYQEPIDELPKICSALEPQQTCFSPDSSSFKGAASTTPIY

SEQ ID NO: 919 - protein, 289 aa, Homo sapiens
MVCGRQLSGAGSETLKQRRTQIMSRGLPKQKPIEGVKQVIVVASGKGGVGKSTTAVNLALALAANDSSKAIGLLDVDVYGPSVPKMMNLKGNPELSQSNLMRPLLNYGIACMSMGFLVEESEPVVWRGLMVMSAIEKLLRQVDWGQLDYLVVDMPPGTGDVQLSVSQNIPITGAVIVSTPQDIALMDAHKGAEMFRRVHVPVLGLVQNMSVFQCPKCKHKTHIFGADGARKLAQTLGLEVLGDIPLHLNIREASDTGQPIVFSQPESDEAKAYLRIAVEVVRRLPSPSE

SEQ ID NO: 920 - protein, 1499 aa, Homo sapiens
MMAKNKEPRPPSYTISIVGLSGTEKDKGNCGVGKSCLCNRFVRSKADEYYPEHTSVLSTIDFGGRVVNNDHFLYWGDIIQNSEDGVECKIHVIEQTEFIDDQTFLPHRSTNLQPYIKRAAASKLQSAEKLMYICTDQLGLEQDFEQKQMPEGKLNVDGFLLCIDVSQGCNRKFDDQLKFVNNLFVQLSKSKKPVIIAATKCDECVGHYLREVQAFASNKKNLLVVETLSAIKVNIETCFTALVQMLDKTRSKPKIIPYLDAYKTQRQLVVTATDKFEKLVQTVRDYHATWKTVSNKLKNHPDYEEYINLEGTRKARNTFSKHIEQLKQEHIRKRREEYINTLPRAFNTLLPNLEEIEHLNWSEALKLMEKRADFQLCFVVLEKTPWDETDHIDKINDRRIPFDLLSTLEAEKVYQNHVQHLISEKRRVEMKEKFKKTLEKIQFISPGQPWEEVMCFVMEDEAYKYITEADSKEVYGRHQREIVEKAKEEFQEMLFEHSELFYDLDLNATPSSDKMSEIHTVLSEEPRYKALQKLAPDRESLLLKHIGFVYHPTKETCLSGQNCTDIKVEQLLASSLLQLDHGRLRLYHDSTNIDKVNLFILGKDGLAQELANEIRTQSTDDEYALDGKIYELDLRPVDAKSPYFLSQLWTAAFKPHGCFCVFNSIESLSFIGEFIGKIRTEASQIRKDKYMANLPFTLILANQRDSISKNLPILRHQGQQLANKLQCPFVDVPAGTYPRKFNETQIKQALRGVLESVKHNLDVVSPIPANKDLSEADLRIVMCAMCGDPFSVDLILSPFLDSHSCSAAQAGQNNSLMLDKIIGEKRRRIQITILSYHSSIGVRKDELVHGYILVYSAKRKASMGMLRAFLSEVQDTIPVQLVAVTDSQADFFENEAIKELMTEGEHIATEITAKFTALYSLSQYHRQTEVFTLFFSDVLEKKNMIENSYLSDNTRESTHQSEDVFLPSPRDCFPYNNYPDSDDDTEAPPPYSPIGDDVQLLPTPSDRSRYRLDLEGNEYPIHSTPNCHDHERNHKVPPPIKPKPVVPKTNVKALVPNLLRAIEAGIGKNPRKQTSRVPFGPEDMDPSDNYAEPIDTIFKQKGYSDEIYVVPDDSQNRIKIRNSFVNNTQGDEENGFSDRPQKVMGNGGLQNTNINLKPCLVKPSHTIEEHIQMPVMMRLSPLLKPKRKGRHRGSEEDPLLSPVETWKGGIDNPAITSDQELDDKKMKKKTHKVKEDKKKKTKNFNPPTRRNWESNYFGMPLQDLVTAEKPIPLFVEKCVEFIEDTGLCTERLYRVSGNKTDQENIQKQFVQDHNINLVSMEVTVNAVAGALKAFFADLPDPLIPYSLHPELLEAAKIPDKTERLHALKEIVKKFHPVNYDVFRYVITHLNRVSQQHKINLMTADNLSICFGQPLMRPDLKSMEFLSTTKIHQSVVETFIQQCQFFFYNGEIVETTNIVAPPPPSNPGQLVEPMVPLQLPPPLQPQLIQPQLQTDPLGII

SEQ ID NO: 921 - protein, 901 aa, Homo sapiens
MAPTKPSFQQDPSRRERLQALRKEKSRDAARSRRGKENFEFYELAKLLPLPAAITSQLDKASIIRLTISYLKMRDFANQGDPPWNLRMEGPPPNTSVKGAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVESTSPSLLTTDNTLERSFFIRMKSTLTKRGVHIKSSGYKVIHITGRLRLRVSLSHGRTVPSQIMGLVVVAHALPPPTINEVRIDCHMFVTRVNMDLNIIYCENRISDYMDLTPVDIVGKRCYHFIHAEDVEGIRHSHLDLLNKGQCVTKYYRWMQKNGGYIWIQSSATIAINAKNANEKNIIWVNYLLSNPEYKDTPMDIAQLPHLPEKTSESSETSDSESDSKDTSGITEDNENSKSDEKGNQSENSEDPEPDRKKSGNACDNDMNCNDDGHSSSNPDSRDSDDSFEHSDFENPKAGEDGFGALGAMQIKVERYVESESDLRLQNCESLTSDSAKDSDSAGEAGAQASSKHQKRKKRRKRQKGGSASRRRLSSASSPGGLDAGLVEPPRLLSSPNSASVLKIKTEISEPINFDNDSSIWNYPPNREISRNESPYSMTKPPSSEHFPSPQGGGGGGGGGGGLHVAIPDSVLTPPGADGAAARKTQFGASATAALAPVASDPLSPPLSASPRDKHPGNGGGGGGGGGGAGGGGPSASNSLLYTGDLEALQRLQAGNVVLPLVHRVTGTLAATSTAAQRVYTTGTIRYAPAEVTLAMQSNLLPNAHAVNFVDVNSPGFGLDPKTPMEMLYHHVHRLNMSGPFGGAVSAASLTQMPAGNVFTTAEGLFSTLPFPVYSNGIHAAQTLERKED

SEQ ID NO: 922 - protein, 920 aa, Homo sapiens
MAPTKPSFQQDPSRRERLQALRKEKSRDAARSRRGKENFEFYELAKLLPLPAAITSQLDKASIIRLTISYLKMRDFANQGDPPWNLRMEGPPPNTSVKGIQMWKSELCMRKTPCEVIGAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVESTSPSLLTTDNTLERSFFIRMKSTLTKRGVHIKSSGYKVIHITGRLRLRVSLSHGRTVPSQIMGLVVVAHALPPPTINEVRIDCHMFVTRVNMDLNIIYCENRISDYMDLTPVDIVGKRCYHFIHAEDVEGIRHSHLDLLNKGQCVTKYYRWMQKNGGYIWIQSSATIAINAKNANEKNIIWVNYLLSNPEYKDTPMDIAQLPHLPEKTSESSETSDSESDSKDTSGITEDNENSKSDEKGNQSENSEDPEPDRKKSGNACDNDMNCNDDGHSSSNPDSRDSDDSFEHSDFENPKAGEDGFGALGAMQIKVERYVESESDLRLQNCESLTSDSAKDSDSAGEAGAQASSKHQKRKKRRKRQKGGSASRRRLSSASSPGGLDAGLVEPPRLLSSPNSASVLKIKTEISEPINFDNDSSIWNYPPNREISRNESPYSMTKPPSSEHFPSPQGGGGGGGGGGGLHVAIPDSVLTPPGADGAAARKTQFGASATAALAPVASDPLSPPLSASPRDKHPGNGGGGGGGGGGAGGGGPSASNSLLYTGDLEALQRLQAGNVVLPLVHRVTGTLAATSTAAQRVYTTGTIRYAPAEVTLAMQSNLLPNAHAVNFVDVNSPGFGLDPKTPMEMLYHHVHRLNMSGPFGGAVSAASLTQMPAGNVFTTAEGLFSTLPFPVYSNGIHAAQTLERKED

SEQ ID NO: 923 - protein, 233 aa, Homo sapiens
MNRLPDDYDPYAVEEPSDEEPALSSSEDEVDVLLHGTPDQKRKLIRECLTGESESSSEDEFEKEMEAELNSTMKTMEDKLSSLGTGSSSGNGKVATAPTRYYDDIYFDSDSEDEDRAVQVTKKKKKKQHKIPTNDELLYDPEKDNRDQAWVDAQRRGYHGLGPQRSRQQQPVPNSDAGLELSCLHDHTLALIAKGMNHTKTQYRAMFVMNCSINKEEVLRYKASENKEEKAGP

SEQ ID NO: 924 - protein, 290 aa, Homo sapiens
MTKEEFTKMKQELEAEYLAIFKKTVAMHEVFLCRVAAHPILRRDLNFHVFLEYNQDVSVRGKNKKEKLEDFFKNMVKSADGVIVSGVKDVDDFFEHERTFLLEYHNRVKDASAKSDRMTRSHKSAADDYNRIGSSLYALGTQDSTDICKFFLKVSELFDKTRKIEARVSADEDLKLSDLLKYYLRESQAAKDLLYRRSRSLVDYENANKALDKARAKNKDVLQAETSQQLCCQKFEKISESAKQELIDFKTRRVAAFRKNLVELAELELKHAKGNLQLLQNCLAVLNGDT

SEQ ID NO: 925 - protein, 406 aa, Homo sapiens
MMEGLDDGPDFLSEEDRGLKAINVDLQSDAALQVDISDALSERDKVKFTVHTKSSLPNFKQNEFSVVRQHEEFIWLHDSFVENEDYAGYIIPPAPPRPDFDASREKLQKLGEGEGSMTKEEFTKMKQELEAEYLAIFKKTVAMHEVFLCRVAAHPILRRDLNFHVFLEYNQDVSVRGKNKKEKLEDFFKNMVKSADGVIVSGVKDVDDFFEHERTFLLEYHNRVKDASAKSDRMTRSHKSAADDYNRIGSSLYALGTQDSTDICKFFLKVSELFDKTRKIEARVSADEDLKLSDLLKYYLRESQAAKDLLYRRSRSLVDYENANKALDKARAKNKDVLQAETSQQLCCQKFEKISESAKQELIDFKTRRVAAFRKNLVELAELELKHAKGNLQLLQNCLAVLNGDT

SEQ ID NO: 926 - protein, 408 aa, Homo sapiens
MIPGNRMLMVVLLCQVLLGGASHASLIPETGKKKVAEIQGHAGGRRSGQSHELLRDFEATLLQMFGLRRRPQPSKSAVIPDYMRDLYRLQSGEEEEEQIHSTGLEYPERPASRANTVRSFHHEEHLENIPGTSENSAFRFLFNLSSIPENEAISSAELRLFREQVDQGPDWERGFHRINIYEVMKPPAEVVPGHLITRLLDTRLVHHNVTRWETFDVSPAVLRWTREKQPNYGLAIEVTHLHQTRTHQGQHVRISRSLPQGSGNWAQLRPLLVTFGHDGRGHALTRRRRAKRSPKHHSQRARKKNKNCRRHSLYVDFSDVGWNDWIVAPPGYQAFYCHGDCPFPLADHLNSTNHAIVQTLVNSVNSSIPKACCVPTELSAISMLYLDEYDKVVLKNYQEMVVEGCGCR

SEQ ID NO: 927 - protein, 408 aa, Homo sapiens; identical to SEQ ID NO: 926

SEQ ID NO: 928 - protein, 408 aa, Homo sapiens; identical to SEQ ID NO: 926

SEQ ID NO: 929 - protein, 345 aa, Homo sapiens
MILTPIKAYSSPSTTPEARRREPQAPRQPSLMGPESQSPDCKDGAAATGATATPSAGASGGLQPHQLSSCDGELAVAPLPEGDLPGQFTRVMGKVCTQLLVSRPDEENISSYLQLIDKCLIHEAFTETQKKRLLSWKQQVQKLFRSFPRKTLLDISGYRQQRNRGFGQSNSLPTAGSVGGGMGRRNPRQYQIPSRNVPSARLGLLGTSGFVSSNQRNTTATPTIMKQGRQNLWFANPGGSNSMPSRTHSSVQRTRSLPVHTSPQNMLMFQQPGSQVHSGLCLTDLRGWLSLSGAPSMPALTVPKSSQGEFQLPVTEPDINNRLESLCLSMTEHALGDGVDRTSTI

SEQ ID NO: 930 - protein, 1129 aa, Homo sapiens
MPATRKPMRYGHTEGHTEVCFDDSGSFIVTCGSDGDVRIWEDLDDDDPKFINVGEKAYSCALKSGKLVTAVSNNTIQVHTFPEGVPDGILTRFTTNANHVVFNGDGTKIAAGSSDFLVKIVDVMDSSQQKTFRGHDAPVLSLSFDPKDIFLASASCDGSVRVWQISDQTCAISWPLLQKCNDVINAKSICRLAWQPKSGKLLAIPVEKSVKLYRRESWSHQFDLSDNFISQTLNIVTWSPCGQYLAAGSINGLIIVWNVETKDCMERVKHEKGYAICGLAWHPTCGRISYTDAEGNLGLLENVCDPSGKTSSSKVSSRVEKDYNDLFDGDDMSNAGDFLNDNAVEIPSFSKGIINDDEDDEDLMMASGRPRQRSHILEDDENSVDISMLKTGSSLLKEEEEDGQEGSIHNLPLVTSQRPFYDGPMPTPRQKPFQSGSTPLHLTHRFMVWNSIGIIRCYNDEQDNAIDVEFHDTSIHHATHLSNTLNYTIADLSHEAILLACESTDELASKLHCLHFSSWDSSKEWIIDLPQNEDIEAICLGQGWAAAATSALLLRLFTIGGVQKEVFSLAGPVVSMAGHGEQLFIVYHRGTGFDGDQCLGVQLLELGKKKKQILHGDPLPLTRKSYLAWIGFSAEGTPCYVDSEGIVRMLNRGLGNTWTPICNTREHCKGKSDHYWVVGIHENPQQLRCIPCKGSRFPPTLPRPAVAILSFKLPYCQIATEKGQMEEQFWRSVIFHNHLDYLAKNGYEYEESTKNQATKEQQELLMKMLALSCKLEREFRCVELADLMTQNAVNLAIKYASRSRKLILAQKLSELAVEKAAELTATQVEEEEEEEDFRKKLNAGYSNTATEWSQPRFRNQVEEDAEDSGEADDEEKPEIHKPGQNSFSKSTNSSDVSAKSGAVTFSSQGRVNPFKVSASSKEPAMSMNSARSTNILDNMGKSSKKSTALSRTTNNEKSPIIKPLIPKPKPKQASAASYFQKRNSQTNKTEEVKEENLKNVLSETPAICPPQNTENQRPKTGFQMWLEENRSNILSDNPDFSDEADIIKEGMIRFRVLSTEERKVWANKAKGETASEGTEAKKRKRVVDESDETENQEEKAKENLNLSKKQKPLDFSTNQKLSAFAFKQE

SEQ ID NO: 931 - protein, 245 aa, Homo sapiens
MSDEFSLADALPEHSPAKTSAVSNTKPGQPPQGWPGSNPWNNPSAPSSVPSGLPPSATPSTVPFGPAPTGMYPSVPPTGPPPGPPAPFPPSGPSCPPPGGPYPAPTVPGPGPTGPYPTPNMPFPELPRPYGAPTDPAAAGPLGPWGSMSSGPWAPGMGGQYPTPNMPYPSPGPYPAPPPPQAPGAAPPVPWGTVPPGAWGPPAPYPAPTGSYPTPGLYPTPSNPFQVPSGPSGAPPMPGGPHSYH

SEQ ID NO: 932 - protein, 846 aa, Homo sapiens
MSSSHFASRHRKDISTEMIRTKIAHRKSLSQKENRHKEYERNRHFGLKDVNIPTLEGRILVELDETSQELVPEKTNVKPRAMKTILGDQRKQMLQKYKEEKQLQKLKEQREKAKRGIFKVGRYRPDMPCFLLSNQNAVKAEPKKAIPSSVRITRSKAKDQMEQTKIDNESDVRAIRPGPRQTSEKKVSDKEKKVVQPVMPTSLRMTRSATQAAKQVPRTVSSTTARKPVTRAANENEPEGKVPSKGRPAKNVETKPDKGISCKVDSEENTLNSQTNATSGMNPDGVLSKMENLPEINTAKIKGKNSFAPKDFMFQPLDGLKTYQVTPMTPRSANAFLTPSYTWTPLKTEVDESQATKEILAQKCKTYSTKTIQQDSNKLPCPLGPLTVWHEEHVLNKNEATTKNLNGLPIKEVPSLERNEGRIAQPHHGVPYFRNILQSETEKLTSHCFEWDRKLELDIPDDAKDLIRTAVGQTRLLMKERFKQFEGLVDDCEYKRGIKETTCTDLDGFWDMVSFQIEDVIHKFNNLIKLEESGWQVNNNMNHNMNKNVFRKKVVSGIASKPKQDDAGRIAARNRLAAIKNAMRERIRQEECAETAVSVIPKEVDKIVFDAGFFRVESPVKLFSGLSVSSEGPSQRLGTPKSVNKAVSQSRNEMGIPQQTTSPENAGPQNTKSEHVKKTLFLSIPESRSSIEDAQCPGLPDLIEENHVVNKTDLKVDCLSSERMSLPLLAGGVADDINTNKKEGISDVVEGMELNSSITSQDVLMSSPEKNTASQNSILEEGETKISQSELFDNKSLTTECHLLDSPGLNCSNPFTQLERRHQEHARHISFGGNLITFSPLQPGEF

SEQ ID NO: 933 - protein, 711 aa, Homo sapiens
MHLKPYWKLQKKEHPPEVSRETQRTPMNHQKAVNDETCKASHITSSVFPSASLGKASSRKPFGILSPNVLCSMSGKSPVESSLNVKTKKNAPSATIHQGEEEGPLDIWAVVKPGNTKEKIAFFASHQCSNRIGSMKIKSSWDIDGRATKRRKKSGDLKKAKVQVERMREVNSRCYQPEPFACGIEHCSVHYVSDSGDGVYAGRPLSVIQMVAFLEQRASALLASCSKNCTNSPAIVRFSGQSRGVPAVSESYSAPGACEEPTERGNLEVGEPQSEPVRVLDMVAKLESECLKRQGQREPGSLSRNNSFRRNVGRVLLANSTQADEGKTKKGVLEAPDTQVNPVGSVSVDCGPSRADRCSPKEDQAWDGASQDCPPLPAGVSFHIDSAELEPGSQTAVKNSNRYDVEMTDELVGLPFSSHTYSQASELPTDAVDCMSRELVSLTSRNPDQRKESLCISITVSKVDKDQPSILNSCEDPVPGMLFFLPPGQHLSDYSQLNESTTKESSEASQLEDAAGGDSASEEKSGSAEPFVLPASSVESTLPVLEASSWKKQVSHDFLETRFKIQQLLEPQQYMAFLPHHIMVKIFRLLPTKSLVALKCTCCYFKFIIEYYNIRPADSRWVRDPRYREDPCKQCKKKYVKGDVSLCRWHPKPYCQALPYGPGYWMCCHRSQKGFPGCKLGLHDNHWVPACHSFNRAIHKKAKGTEAEEEY

SEQ ID NO: 934 - protein, 1357 aa, Homo sapiens
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNDLREKNWEAMEALASTEKMLQDKVNKTSKERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKDLLTELQKKLDDSYSEAVRQNEELNLLKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 935 - protein, 1357 aa, Homo sapiens; identical to SEQ ID NO: 934

SEQ ID NO: 936 - protein, 490 aa, Homo sapiens
MAQRAVWLISHEPGTPLCGTVRFSRRYPTVEKRARVFNGASYVPVPEDGPFLKALLFELRLLDDDKDFVESRDSCSRINKTSIYGLLIGGEELWPVVAFLKNDMIYACVPLVEQTLSPRPPLISVSGVSQGFEFLFGIQDFLYSGQKNDSELNTKLSQLPDLLLQACPFGTLLDANLQNSLDNTNFASVTQPQKQPAWKTGTYKGKPQVSISITEKVKSMQYDKQGIADTWQVVGTVTCKCDLEGIMPNVTISLSLPTNGSPLQDILVHPCVTSLDSAILTSSSIDAMDDSAFSGPYKFPFTPPLESFNLCFYTSQVPAPPILGFYQMKEEEVQLRITINLKLHESVKNNFEFCEAHIPFYNRGPITHLEYKTSFGQLEVFREKSLLIWIIGQKFPKSMEISLSGTVTFGAKSHEKQPFDPICTGETAYLKLHFRILDYTLTGCYADQHSVQVFASGKPKISAHRKLISSDYYIWNSKAPAPVTYGSLLL

SEQ ID NO: 937 - protein, 417 aa, Homo sapiens
MPLYEGLGSGGEKTAVVIDLGEAFTKCGFAGETGPRCIIPSVIKRAGMPKPVRVVQYNINTEELYSYLKEFIHILYFRHLLVNPRDRRVVIIESVLCPSHFRETLTRVLFKYFEVPSVLLAPSHLMALLTLGINSAMVLDCGYRESLVLPIYEGIPVLNCWGALPLGGKALHKELETQLLEQCTVDTSVAKEQSLPSVMGSVPEGVLEDIKARTCFVSDLKRGLKIQAAKFNIDGNNERPSPPPNVDYPLDGEKILHILGSIRDSVVEILFEQDNEEQSVATLILDSLIQCPIDTRKQLAENLVVIGGTSMLPGFLHRLLAEIRYLVEKPKYKKALGTKTFRIHTPPAKANCVAWLGGAIFGALQDILGSRSVSKEYYNQTGRIPDWCSLNNPPLEMMFDVGKTQPPLMKRAFSTEK

SEQ ID NO: 938 - protein, 279 aa, Homo sapiens
MPYIPLMEFSCSHSHLVCLPAEWRTSCMPSSKMKEMSSLFPEDWYQFVLRQLECYHSEEKASNVLEEIAKDKVLKDFYVHTVMTCYFSLFGIDNMAPSPGHILRVYGGVLPWSVALDWLTEKPELFQLALKAFRYTLKLMIDKASLGPIEDFRELIKYLEEYERDWYIGLVSDEKWKEAILQEKPYLFSLGYDSNMGIYTGRVLSLQELLIQVGKLNPEAVRGQWANLSWELLYATNDDEERYSIQAHPLLLRNLTVQAAEPPLGYPIYSSKPLHIHLY

SEQ ID NO: 939 - protein, 683 aa, Homo sapiens
MSSGTMKFNGYLRVRIGEAVGLQPTRWSLRHSLFKKGHQLLDPYLTVSVDQVRVGQTSTKQKTNKPTYNEEFCANVTDGGHLELAVFHETPLGYDHFVANCTLQFQELLRTTGASDTFEGWVDLEPEGKVFVVITLTGSFTEATLQRDRIFKHFTRKRQRAMRRRVHQINGHKFMATYLRQPTYCSHCREFIWGVFGKQGYQCQVCTCVVHKRCHHLIVTACTCQNNINKVDSKIAEQRFGINIPHKFSIHNYKVPTFCDHCGSLLWGIMRQGLQCKICKMNVHIRCQANVAPNCGVNAVELAKTLAGMGLQPGNISPTSKLVSRSTLRRQGKESSKEGNGIGVNSSNRLGIDNFEFIRVLGKGSFGKVMLARVKETGDLYAVKVLKKDVILQDDDVECTMTEKRILSLARNHPFLTQLFCCFQTPDRLFFVMEFVNGGDLMFHIQKSRRFDEARARFYAAEIISALMFLHDKGIIYRDLKLDNVLLDHEGHCKLADFGMCKEGICNGVTTATFCGTPDYIAPEILQEMLYGPAVDWWAMGVLLYEMLCGHAPFEAENEDDLFEAILNDEVVYPTWLHEDATGILKSFMTKNPTMRLGSLTQGGEHAILRHPFFKEIDWAQLNHRQIEPPFRPRIKSREDVSNFDPDFIKEEPVLTPIDEGHLPMINQDEFRNFSYVSPELQP

SEQ ID NO: 940 - protein, 826 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 941 - protein, 735 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGII

SEQ ID NO: 942 - protein, 368 aa, Homo sapiens
MGTPPGLQTDCEALLSRFQETDSVRFEDFTELWRNMKFGTIFCGRMRNLEKNMFTKEALALAWRYFLPPYTFQIRVGALYLLYGLYNTQLCQPKQKIRVALKDWDEVLKFQQDLVNAQHFDAAYIFRKLRLDRAFHFTAMPKLLSYRMKKKIHRAEVTEEFKDPSDRVMKLITSDVLEEMLNVHDHYQNMKHVISVDKSKPDKALSLIKDDFFDNIKNIVLEHQQWHKDRKNPSLKSKTNDGEEKMEGNSQETERCERAESLAKIKSKAFSVVIQASKSRRHRQVKLDSSDSDSASGQGQVKATRKKEKKERLKPAGRKMSLRNKGNVQNIHKEDKPLSLSMPVITEEEENESLSGTEFTASKKRRKH

SEQ ID NO: 943 - protein, 644 aa, Homo sapiens
MAKPSHSSYVLQQLNNQREWGFLCDCCIAIDDIYFQAHKAVLAACSSYFRMFFMNHQHSTAQLNLSNMKISAECFDLILQFMYLGKIMTAPSSFEQFKVAMNYLQLYNVPDCLEDIQDADCSSSKCSSSASSKQNSKMIFGVRMYEDTVARNGNEANRWCAEPSSTVNTPHNREADEESLQLGNFPEPLFDVCKKSSVSKLSTPKERVSRRFGRSFTCDSCGFGFSCEKLLDEHVLTCTNRHLYQNTRSYHRIVDIRDGKDSNIKAEFGEKDSSKTFSAQTDKYRGDTSQAADDSASTTGSRKSSTVESEIASEEKSRAAERKRIIIKMEPEDIPTDELKDFNIIKVTDKDCNESTDNDELEDEPEEPFYRYYVEEDVSIKKSGRKTLKPRMSVSADERGGLENMRPPNNSSPVQEDAENASCELCGLTITEEDLSSHYLAKHIENICACGKCGQILVKGRQLQEHAQRCGEPQDLTMNGLGNTEEKMDLEENPDEQSEIRDMFVEMLDDFRDNHYQINSIQKKQLFKHSACPFRCPNCGQRFETENLVVEHMSSCLDQDMFKSAIMEENERDHRRKHFCNLCGKGFYQRCHLREHYTVHTKEKQFVCQTCGKQFLRERQLRLHNDMHKGMASGEIGPSKPVEK

SEQ ID NO: 944 - protein, 411 aa, Homo sapiens
MSKRPSYAPPPTPAPATQMPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEETHLEETTESQQNGEEGTSTPEDKESGQEGVDSMAEEGTSDSNTGSESNSATVEEPPTDPIPEDEKKE

SEQ ID NO: 945 - protein, 584 aa, Homo sapiens
MSVRYSSSKHYSSSRSGGGGGGGGCGGGGGVSSLRISSSKGSLGGGFSSGGFSGGSFSRGSSGGGCFGGSSGGYGGLGGFGGGSFRGSYGSSSFGGSYGGSFGGGSFGGGSFGGGSFGGGGFGGGGFGGGFGGGFGGDGGLLSGNEKVTMQNLNDRLASYLDKVRALEESNYELEGKIKEWYEKHGNSHQGEPRDYSKYYKTIDDLKNQILNLTTDNANILLQIDNARLAADDFRLKYENEVALRQSVEADINGLRRVLDELTLTKADLEMQIESLTEELAYLKKNHEEEMKDLRNVSTGDVNVEMNAAPGVDLTQLLNNMRSQYEQLAEQNRKDAEAWFNEKSKELTTEIDNNIEQISSYKSEITELRRNVQALEIELQSQLALKQSLEASLAETEGRYCVQLSQIQAQISALEEQLQQIRAETECQNTEYQQLLDIKIRLENEIQTYRSLLEGEGSSGGGGRGGGSFGGGYGGGSSGGGSSGGGYGGGHGGSSGGGYGGGSSGGGSSGGGYGGGSSSGGHGGSSSGGYGGGSSGGGGGGYGGGSSGGGSSSGGGYGGGSSSGGHKSSSSGSVGESSSKGPRY

SEQ ID NO: 946 - protein, 2192 aa, Homo sapiens
MSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSMMSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 947 - protein, 191 aa, Homo sapiens
MGKSCKVVVCGQASVGKTSILEQLLYGNHVVGSEMIETQEDIYVGSIETDRGVREQVRFYDTRGLRDGAELPRHCFSCTDGYVLVYSTDSRESFQRVELLKKEIDKSKDKKEVTIVVLGNKCDLQEQRRVDPDVAQHWAKSEKVKLWEVSVADRRSLLEPFVYLASKMTQPQSKSAFPLSRKNKGSGSLDG

SEQ ID NO: 948 - protein, 216 aa, Homo sapiens
MAGRGGAARPNGPAAGNKICQFKLVLLGESAVGKSSLVLRFVKGQFHEYQESTIGAAFLTQTVCLDDTTVKFEIWDTAGQERYHSLAPMYYRGAQAAIVVYDITNTDTFARAKNWVKELQRQASPNIVIALAGNKADLASKRAVEFQEAQAYADDNSLLFMETSAKTAMNVNEIFMAIAKKLPKNEPQNATGAPGRNRGVDLQENNPASRSQCCSN

SEQ ID NO: 949 - protein, 216 aa, Homo sapiens; identical to SEQ ID NO: 948

SEQ ID NO: 950 - protein, 787 aa, Homo sapiens
MAVWIQAQQLQGEALHQMQALYGQHFPIEVRHYLSQWIESQAWDSVDLDNPQENIKATQLLEGLVQELQKKAEHQVGEDGFLLKIKLGHYATQLQNTYDRCPMELVRCIRHILYNEQRLVREANNGSSPAGSLADAMSQKHLQINQTFEELRLVTQDTENELKKLQQTQEYFIIQYQESLRIQAQFGPLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNDYSGEILNNCCVMEYHQATGTLSAHFRNMSLKRIKRSDRRGAESVTEEKFTILFESQFSVGGNELVFQVKTLSLPVVVIVHGSQDNNATATVLWDNAFAEPGRVPFAVPDKVLWPQLCEALNMKFKAEVQSNRGLTKENLVFLAQKLFNNSSSHLEDYSGLSVSWSQFNRENLPGRNYTFWQWFDGVMEVLKKHLKPHWNDGAILGFVNKQQAHDLLINKPDGTFLLRFSDSEIGGITIAWKFDSQERMFWNLMPFTTRDFSIRSLADRLGDLNYLIYVFPDRPKDEVYSKYYTPVPCESATAKAVDGYVKPQIKQVVPEFVNASADAGGGSATYMDQAPSPAVCPQAHYNMYPQNPDSVLDTDGDFDLEDTMDVARRVEELLGRPMDSQWIPHAQS

SEQ ID NO: 951 - protein, 831 aa, Homo sapiens
MGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEANFEKIENELKEINTNQEALKRNFLELTELKFILRKTQQFFDEMADPDLLEESSSLLEPSEMGRGTPLRLGFVAGVINRERIPTFERMLWRVCRGNVFLRQAEIENPLEDPVTGDYVHKSVFIIFFQGDQLKNRVKKICEGFRASLYPCPETPQERKEMASGVNTRIDDLQMVLNQTEDHRQRVLQAAAKNIRVWFIKVRKMKAIYHTLNLCNIDVTQKCLIAEVWCPVTDLDSIQFALRRGTEHSGSTVPSILNRMQTNQTPPTYNKTNKFTYGFQNIVDAYGIGTYREINPAPYTIITFPFLFAVMFGDFGHGILMTLFAVWMVLRESRILSQKNENEMFSTVFSGRYIILLMGVFSMYTGLIYNDCFSKSLNIFGSSWSVRPMFTYNWTEETLRGNPVLQLNPALPGVFGGPYPFGIDPIWNIATNKLTFLNSFKMKMSVILGIIHMLFGVSLSLFNHIYFKKPLNIYFGFIPEIIFMTSLFGYLVILIFYKWTAYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEFDFGDTMVHQAIHTIEYCLGCISNTASYLRLWALSLAHAQLSEVLWTMVIHIGLSVKSLAGGLVLFFFFTAFATLTVAILLIMEGLSAFLHALRLHWVEFQNKFYSGTGFKFLPFSFEHIREGKFEE

SEQ ID NO: 952 - protein, 298 aa, Homo sapiens
MTEPGASPEDPWVKASPVGAHAGEGRAGRARARRGAGRRGASLLSPKSPTLSVPRGCREDSSHPACAKVEYAYSDNSLDPGLFVESTRKGSVVSRANSIGSTSASSVPNTDDEDSDYHQEAYKESYKDRRRRAHTQAEQKRRDAIKRGYDDLQTIVPTCQQQDFSIGSQKLSKAIVLQKTIDYIQFLHKEKKKQEEEVSTLRKDVTALKIMKVNYEQIVKAHQDNPHEGEDQVSDQVKFNVFQGIMDSLFQSFNASISVASFQELSACVFSWIEEHCKPQTLREIVIGVLHQLKNQLY

SEQ ID NO: 953 - protein, 244 aa, Homo sapiens
MTEPGASPEDPWVKVEYAYSDNSLDPGLFVESTRKGSVVSRANSIGSTSASSVPNTDDEDSDYHQEAYKESYKDRRRRAHTQAEQKRRDAIKRGYDDLQTIVPTCQQQDFSIGSQKLSKAIVLQKTIDYIQFLHKEKKKQEEEVSTLRKDVTALKIMKVNYEQIVKAHQDNPHEGEDQVSDQVKFNVFQGIMDSLFQSFNASISVASFQELSACVFSWIEEHCKPQTLREIVIGVLHQLKNQLY

SEQ ID NO: 954 - protein, 214 aa, Homo sapiens
MTEPGASPEDPWVKVEYAYSDNSLDPDDEDSDYHQEAYKESYKDRRRRAHTQAEQKRRDAIKRGYDDLQTIVPTCQQQDFSIGSQKLSKAIVLQKTIDYIQFLHKEKKKQEEEVSTLRKDVTALKIMKVNYEQIVKAHQDNPHEGEDQVSDQVKFNVFQGIMDSLFQSFNASISVASFQELSACVFSWIEEHCKPQTLREIVIGVLHQLKNQLY

SEQ ID NO: 955 - protein, 205 aa, Homo sapiens
MSKGRAEAAAGAAGILLRYLQEQNRPYSSQDVFGNLQREHGLGKAVVVKTLEQLAQQGKIKEKMYGKQKIYFADQDQFDMVSDADLQVLDGKIVALTAKVQSLQQSCRYMEAEMQKEIQELKKECAGYRERLKNIKAATNHVTPEEKEQVYRERQKYCKEWRKRKRMATELSDAILEGYPKSKKQFFEEVGIETDEDYNVTLPDP

SEQ ID NO: 956 - protein, 217 aa, Homo sapiens
MSKGRAEAAAGAAGILLRYLQEQNRPYSSQDVFGNLQREHGLGKAVVVKTLEQLAQQGKIKEKMYGKQKIYFADQDQFDMVSDADLQVLDGKIVALTAKVQSLQQSCRYMEAELKELSSALTTPEMQKEIQELKKECAGYRERLKNIKAATNHVTPEEKEQVYRERQKYCKEWRKRKRMATELSDAILEGYPKSKKQFFEEVGIETDEDYNVTLPDP

SEQ ID NO: 957 - protein, 466 aa, Homo sapiens
MAEAEGVPTTPGPASGSTFRGRRDVSGSWERDQQVEAAQRALVEVLGPYEPLLSRVQAALVWERPARSALWCLGLNAAFWFFALTSLRLVFLLAFGLMIIVCIDQWKNKIWPEIKVPRPDALDNESWGFVHPRLLSVPELCHHVAEVWVSGTIFIRNVLLFKKQNPGKFCLLSCGILTFLAVLGRYVPGLLLSYLMLVTVMMWPLAVYHRLWDRAYVRLKPALQRLDFSVRGYMMSKQRERQLRRRALHPERAMDNHSDSEEELAAFCPQLDDSTVARELAITDSEHSDAEVSCTDNGTFNLSRGQTPLTEGSEDLDGHSDPEESFARDLPDFPSINMDPAGLDDEDDTSIGMPSLMYRSPPGAEEPQAPPASRDEAALPELLLGALPVGSNLTSNLASLVSQGMIQLALSGASQPGPSGAPAQRATRGFLRSPSSDLDTDAEGDDFELLDQSELSQLDPASSRSH

SEQ ID NO: 958 - protein, 747 aa, Homo sapiens
MEIPNPPTSKCITYWKRKVKSEYMRLRQLKRLQANMGAKALYVANFAKVQEKTQILNEEWKKLRVQPVQSMKPVSGHPFLKKCTIESIFPGFASQHMLMRSLNTVALVPIMYSWSPLQQNFMVEDETVLCNIPYMGDEVKEEDETFIEELINNYDGKVHGEEEMIPGSVLISDAVFLELVDALNQYSDEEEEGHNDTSDGKQDDSKEDLPVTRKRKRHAIEGNKKSSKKQFPNDMIFSAIASMFPENGVPDDMKERYRELTEMSDPNALPPQCTPNIDGPNAKSVQREQSLHSFHTLFCRRCFKYDCFLHPFHATPNVYKRKNKEIKIEPEPCGTDCFLLLEGAKEYAMLHNPRSKCSGRRRRRHHIVSASCSNASASAVAETKEGDSDRDTGNDWASSSSEANSRCQTPTKQKASPAPPQLCVVEAPSEPVEWTGAEESLFRVFHGTYFNNFCSIARLLGTKTCKQVFQFAVKESLILKLPTDELMNPSQKKKRKHRLWAAHCRKIQLKKDNSSTQVYNYQPCDHPDRPCDSTCPCIMTQNFCEKFCQCNPDCQNRFPGCRCKTQCNTKQCPCYLAVRECDPDLCLTCGASEHWDCKVVSCKNCSIQRGLKKHLLLAPSDVAGWGTFIKESVQKNEFISEYCGELISQDEADRRGKVYDKYMSSFLFNLNNDFVVDATRKGNKIRFANHSVNPNCYAKVVMVNGDHRIGIFAKRAIQAGEELFFDYRYSQADALKYVGIERETDVL

SEQ ID NO: 959 - protein, 747 aa, Homo sapiens; identical to SEQ ID NO: 958

SEQ ID NO: 960 - protein, 106 aa, Homo sapiens
MASSGAGDPLDSKRGEAPFAQRIDPTREKLTPEQLHSMRQAELAQWQKVLPRRRTRNIVTGLGIGALVLAIYGYTFYSISQERFLDELEDEAKAARARALARASGS

SEQ ID NO: 961 - protein, 450 aa, Homo sapiens
MEGSKTSNNSTMQVSFVCQRCSQPLKLDTSFKILDRVTIQELTAPLLTTAQAKPGETQEEETNSGEEPFIETPRQDGVSRRFIPPARMMSTESANSFTLIGEASDGGTMENLSRRLKVTGDLFDIMSGQTDVDHPLCEECTDTLLDQLDTQLNVTENECQNYKRCLEILEQMNEDDSEQLQMELKELALEEERLIQELEDVEKNRKIVAENLEKVQAEAERLDQEEAQYQREYSEFKRQQLELDDELKSVENQMRYAQTQLDKLKKTNVFNATFHIWHSGQFGTINNFRLGRLPSVPVEWNEINAAWGQTVLLLHALANKMGLKFQRYRLVPYGNHSYLESLTDKSKELPLYCSGGLRFFWDNKFDHAMVAFLDCVQQFKEEVEKGETRFCLPYRMDVEKGKIEDTGGSGGSYSIKTQFNSEEQWTKALKFMLTNLKWGLAWVSSQFYNK

SEQ ID NO: 962 - protein, 254 aa, Homo sapiens
MASLLKVDQEVKLKVDSFRERITSEAEDLVANFFPKKLLELDSFLKEPILNIHDLTQIHSDMNLPVPDPILLTNSHDGLDGPTYKKRRLDECEEAFQGTKVFVMPNGMLKSNQQLVDIIEKVKPEIRLLIEKCNTVKMWVQLLIPRIEDGNNFGVSIQEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 963 - protein, 267 aa, Homo sapiens
MASLLKVDQEVKLKVDSFRERITSEAEDLVANFFPKKLLELDSFLKEPILNIHDLTQIHSDMNLPVPDPILLTNSHDGLDGPTYKKRRLDECEEAFQGTKVFVMPNGMLKSNQQLVDIIEKVKPEIRLLIEKCNTPSGKGPHICFDLQVKMWVQLLIPRIEDGNNFGVSIQEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 964 - protein, 729 aa, Homo sapiens
MHLKIVLAFLALSLITIFALAYVLLTSPGGSSQPPHCPSVSHRAQPWPHPGQSQLFADLSREELTAVMRFLTQRLGPGLVDAAQAQPSDNCIFSVELQLPPKAAALAHLDRGSPPPAREALAIVLFGGQPQPNVSELVVGPLPHPSYMRDVTVERHGGPLPYHRRPVLRAEFTQMWRHLKDVELPKAPIFLSSTFNYNGSTLAAVHATPRGLRSRERTTWIGLYHNISGVGLFLHPVGLELLLDHRALDPAHWTVQQVFYLGHYYADLGQLEREFKSGRLEVVRVPLPPPNGASSLRSRNSPGPLPPLQFSPQGSQYSVQGNLVVSSLWSFTFGHGVFSGLRIFDVRFQGERIAYEVSVQECVSIYGADSPKTMLTRYLDSSFGLGRNSRGLVRGVDCPYQATMVDIHILVGKGAVQLLPGAVCVFEEAQGLPLRRHHNYLQNHFYGGLASSALVVRSVSSVGNYDYIWDFVLYPNGALEGRVHATGYINTAFLKGGEEGLLFGNRVGERVLGTVHTHAFHFKLDLDVAGLKNWVVAEDVVFKPVAAPWNPEHWLQRPQLTRQVLGKEDLTAFSLGSPLPRYLYLASNQTNAWGHQRGYQLVVTQRKEEESQSSSIYHQNDIWTPTVTFADFINNETLLGEDLVAWVTASFLHIPHAEDIPNTVTLGNRVGFLLRPYNFFDEDPSIFSPGSVYFEKGQDAGLCSINPVACLPDLAACVPDLPPFSYHGF

SEQ ID NO: 965 - protein, 756 aa, Homo sapiens
MHLKIVLAFLALSLITIFALAYVLLTSPGGSSQPPHCPSVSHRAQPWPHPGQSQLFADLSREELTAVMRFLTQRLGPGLVDAAQAQPSDNCIFSVELQLPPKAAALAHLDRGSPPPAREALAIVLFGGQPQPNVSELVVGPLPHPSYMRDVTVERHGGPLPYHRRPVLRAEFTQMWRHLKDVELPKAPIFLSSTFNYNGSTLAAVHATPRGLRSRERTTWMALYHNISGVGLFLHPVGLELLLDHRALDPAHWTVQQVFYLGHYYADLGQLEREFKSGRLEVVRVPLPPPNGASSLRSRNSPGPLPPLQFSPQGSQYSVQGNLVVSSLWSFTFGHGVFSGLRIFDVRFQGERIAYEVSVQECVSIYGADSPKTMLTRYLDSSFGLGRNSRGLVRGVDCPYQATMVDIHILVGKGAVQLLPGAVCVFEEAQGLPLRRHHNYLQNHFYGGLASSALVVRSVSSVGNYDYIWDFVLYPNGALEGRVHATGYINTAFLKGGEEGLLFGNRVGERVLGTVHTHAFHFKLDLDVAGLKNWVVAEDVVFKPVAAPWNPEHWLQRPQLTRQVLGKEDLTAFSLGSPLPRYLYLASNQTNAWGHQRGYRIQIHSPLGIQIPLESDMERALSWGRYQLVVTQRKEEESQSSSIYHQNDIWTPTVTFADFINNETLLGEDLVAWVTASFLHIPHAEDIPNTVTLGNRVGFLLRPYNFFDEDPSIFSPGSVYFEKGQDAGLCSINPVACLPDLAACVPDLPPFSYHGF

SEQ ID NO: 966 - protein, 525 aa, Homo sapiens
MEFCVEDSTDVHVLIEDHRIVFSCKNADGVELYNEIEFYAKVNSKDSQDKRSSRSITCFVRKWKEKVAWPRLTKEDIKPVWLSVDFDNWRDWEGDEEMELAHVEHYAELLKKVSTKRPPPAMDDLDFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWELGRFRSAIELDTPSMTAEQVAAIEQSVNEKIRDRLPVNVRELSLDDPEVEQVSGRGLPDDHAGPIRVVNIEGVDSNMCCGTHVSNLSDLQVIKILGTEKGKKNRTNLIFLSGNRVLKWMERSHGTEKALTALLKCGAEDHVEAVKKLQNSTKILQKNNLNLLRDLAVHIAHSLRNSPDWGGVVILHRKEGDSEFMNIIANEIGSEETLLFLTVGDEKGGGLFLLAGPPASVETLGPRVAEVLEGKGAGKKGRFQGKATKMSRRMEAQALLQDYISTQSAKE

SEQ ID NO: 967 - protein, 136 aa, Homo sapiens [sequence omitted]

SEQ ID NO: 968 - protein, 185 aa, Homo sapiens
MSGSFELSVQDLNDLLSDGSGCYSLPSQPCNEVTPRIYVGNASVAQDIPKLQKLGITHVLNAAEGRSFMHVNTNANFYKDSGITYLGIKANDTQEFNLSAYFERAADFIDQALAQKNGRVLVHCREGYSRSPTLVIAYLMMRQKMDVKSALSIVRQNREIGPNDGFLAQLCQLNDRLAKEGKLKP

SEQ ID NO: 969 - protein, 585 aa, Homo sapiens
MPVLSEDSGLHETLALLTSQLRPDSNHKEEMGFLRDVFSEKSLSYLMKIHEKLRYYERQSPTPVLHSAVALAEDVMEELQAASVHSDERELLQLLSTPHLRAVLMVHDTVAQKNFDPVLPPLPDNIDEDFDEESVKIVRLVKNKEPLGATIRRDEHSGAVVVARIMRGGAADRSGLVHVGDELREVNGIAVLHKRPDEISQILAQSQGSITLKIIPATQEEDRLKESKVFMRALFHYNPREDRAIPCQEAGLPFQRRQVLEVVSQDDPTWWQAKRVGDTNLRAGLIPSKGFQERRLSYRRAAGTLPSPQSLRKPPYDQPCDKETCDCEGYLKGHYVAGLRRSFRLGCRERLGGSQEGKMSSGAESPELLTYEEVARYQHQPGERPRLVVLIGSLGARLHELKQKVVAENPQHFGVAVPHTTRPRKSHEKEGVEYHFVSKQAFEADLHHNKFLEHGEYKENLYGTSLEAIQAVMAKNKVCLVDVEPEALKQLRTSEFKPYIIFVKPAIQEKRKTPPMSPACEDTAAPFDEQQQEMAASAAFIDRHYGHLVDAVLVKEDLQGAYSQLKVVLEKLSKDTHWVPVSWVR

SEQ ID NO: 970 - protein, 552 aa, Homo sapiens
MPVAATNSETAMQQVLDNLGSLPSATGAAELDLIFLRGIMESPIVRSLAKAHERLEETKLEAVRDNNLELVQEILRDLAQLAEQSSTAAELAHILQEPHFQSLLETHDSVASKTYETPPPSPGLDPTFSNQPVPPDAVRMVGIRKTAGEHLGVTFRVEGGELVIARILHGGMVAQQGLLHVGDIIKEVNGQPVGSDPRALQELLRNASGSVILKILPSYQEPHLPRQVFVKCHFDYDPARDSLIPCKEAGLRFNAGDLLQIVNQDDANWWQACHVEGGSAGLIPSQLLEEKRKAFVKRDLELTPNSGTLCGSLSGKKKKRMMYLTTKNAEFDRHELLIYEEVARMPPFRRKTLVLIGAQGVGRRSLKNKLIMWDPDRYGTTVPYTSRRPKDSEREGQGYSFVSRGEMEADVRAGRYLEHGEYEGNLYGTRIDSIRGVVAAGKVCVLDVNPQAVKVLRTAEFVPYVVFIEAPDFETLRAMNRAALESGISTKQLTEADLRRTVEESSRIQRGYGHYFDLCLVNSNLERTFRELQTAMEKLRTEPQWVPVSWVY

SEQ ID NO: 971 - protein, 346 aa, Homo sapiens
MESTLGAGIVIAEALQNQLAWLENVWLWITFLGDPKILFLFYFPAAYYASRRVGIAVLWISLITEWLNLIFKWFLFGDRPFWWVHESGYYSQAPAQVHQFPSSCETGPGSPSGHCMITGAALWPIMTALSSQVATRARSRWVRVMPSLAYCTFLLAVGLSRIFILAHFPHQVLAGLITGAVLGWLMTPRVPMERELSFYGLTALALMLGTSLIYWTLFTLGLDLSWSISLAFKWCERPEWIHVDSRPFASLSRDSGAALGLGIALHSPCYAQVRRAQLGNGQKIACLVLAMGLLGPLDWLGHPPQISLFYIFNFLKYTLWPCLVLALVPWAVHMFSAQEAPPIHSS

SEQ ID NO: 972 - protein, 346 aa, Homo sapiens; identical to SEQ ID NO: 971

SEQ ID NO: 973 - protein, 94 aa, Homo sapiens
MELSDVTLIEGVGNEVMVVAGVVVLILALVLAWLSTYVADSGSNQLLGAIVSAGDTSVLHLGHVDHLVAGQGNPEPTELPHPSEANTSLDKKAR

SEQ ID NO: 974 - protein, 301 aa, Homo sapiens
MELSDVTLIEGVGNEVMVVAGVVVLILALVLAWLSTYVADSGSNQLLGAIVSAGDTSVLHLGHVDHLVAGQGNPEPTELPHPSEGNDEKAEEAGEGRGDSTGEAGAGGGVEPSLEHLLDIQGLPKRQAGAGSSSPEAPLRSEDSTCLPPSPGLITVRLKFLNDTEELAVARPEDTVGALKSKYFPGQESQMKLIYQGRLLQDPARTLRSLNITDNCVIHCHRSPPGSAVPGPSASLAPSATEPPRLGVNVGSLMVPVFVVLLGVVWYFRINYRQFFTAPATVSLVGVTVFFSFLVFGMYGR

SEQ ID NO: 975 - protein, 593 aa, Homo sapiens
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQASCCEDRVHCCPHGAFCDLVHTRCITPTGTHPLAKKLPAQRTNRAVALSSSVMCPDARSRCPDGSTCCELPSGKYGCCPMPNATCCSDHLHCCPQDTVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCQLTSGEWGCCPIPEAVCCSDHQHCCPQGYTCVAEGQCQRGSEIVAGLEKMPARRASLSHPRDIGCDQHTSCPVGQTCCPSLGGSWACCQLPHAVCCEDRQHCCPAGYTCNVKARSCEKEVVSAQPATFLARSPHVGVKDVECGEGHFCHDNQTCCRDNRQGWACCPYRQGVCCADRRHCCPAGFRCAARGTKCLRREAPRWDAPLRDPALRQLL

SEQ ID NO: 976 - protein, 1445 aa, Homo sapiens
MGRMEMELDYAEDATERRRVLEVEKEDTEELRQKYKDYVDKEKAIAKALEDLRANFYCELCDKQYQKHQEFDNHINSYDHAHKQGHEGMQSLTYYFQQADQIKVVRLRLKDLKQREFARNVSSRSRKDEKKQEKALRRLHELAEQRKQAECAPGSGPMFKPTTVAVDEEGGEDDKDESATNSGTGATASCGLGSEFSTDKGGPFTAVQITNTTGLAQAPGLASQGISFGIKNNLGTPLQKLGVSFSFAKKAPVKLESIASVFKDHAEEGTSEDGTKPDEKSSDQGLQKVGDSDGSSNLDGKKEDEDPQDGGSLASTLSKLKRMKREEGAGATEPEYYHYIPPAHCKVKPNFPFLLFMRASEQMDGDNTTHPKNAPESKKGSSPKPKSCIKAAASQGAEKTVSEVSEQPKETSMTEPSEPGSKAEAKKALGGDVSDQSLESHSQKVSETQMCESNSSKETSLATPAGKESQEGPKHPTGPFFPVLSKDESTALQWPSELLIFTKAEPSISYSCNPLYFDFKLSRNKDARTKGTEKPKDIGSSSKDHLQGLDPGEPNKSKEVGGEKIVRSSGGRMDAPASGSACSGLNKQEPGGSHGSETEDTGRSLPSKKERSGKSHRHKKKKKHKKSSKHKRKHKADTEEKSSKAESGEKSKKRKKRKRKKNKSSAPADSERGPKPEPPGSGSPAPPRRRRRAQDDSQRRSLPAEEGSSGKKDEGGGGSSSQDHGGRKHKGELPPSSCQRRAGTKRSSRSSHRSQPSSGDEDSDDASSHRLHQKSPSQYSEEEEEEDSGSEHSRSRSRSGRRHSSHRSSRRSYSSSSDASSDQSCYSRQRSYSDDSYSDYSDRSRRHSKRSHDSDDSDYASSKHRSKRHKYSSSDDDYSLSCSQSRSRSRSHTRERSRSRGRSRSSSCSRSRSKRRSRSTTAHSWQRSRSYSRDRSRSTRSPSQRSGSRKRSWGHESPEERHSGRRDFIRSKIYRSQSPHYFRSGRGEGPGKKDDGRGDDSKATGPPSQNSNIGTGRGSEGDCSPEDKNSVTAKLLLEKIQSRKVERKPSVSEEVQATPNKAGPKLKDPPQGYFGPKLPPSLGNKPVLPLIGKLPATRKPNKKCEESGLERGEEQEQSETEEGPPGSSDALFGHQFPSEETTGPLLDPPPEESKSGEATADHPVAPLGTPAHSDCYPGDPTISHNYLPDPSDGDTLESLDSSSQPGPVESSLLPIAPDLEHFPSYAPPSGDPSIESTDGAEDASLAPLESQPITFTPEEMEKYSKLQQAAQQHIQQQLLAKQVKAFPASAALAPATPALQPIHIQQPATASATSITTVQHAILQHHAAAAAAAIGIHPHPHPQPLAQVHHIPQPHLTPISLSHLTHSIIPGHPATFLASHPIHIIPASAIHPGPFTFHPVPHAALYPTLLAPRPAAAAATALHLHPLLHPIFSGQDLQHPPSHGT

SEQ ID NO: 977 - protein, 496 aa, Homo sapiens
MADESETAVKPPAPPLPQMMEGNGNGHEHCSDCENEEDNSYNRGGLSPANDTGAKKKKKKQKKKKEKGSETDSAQDQPVKMNSLPAERIQEIQKAIELFSVGQGPAKTMEEASKRSYQFWDTQPVPKLGEVVNTHGPVEPDKDNIRQEPYTLPQGFTWDALDLGDRGVLKELYTLLNENYVEDDDNMFRFDYSPEFLLWALRPPGWLPQWHCGVRVVSSRKLVGFISAIPANIHIYDTEKKMVEINFLCVHKKLRSKRVAPVLIREITRRVHLEGIFQAVYTAGVVLPKPVGTCRYWHRSLNPRKLIEVKFSHLSRNMTMQRTMKLYRLPETPKTAGLRPMETKDIPVVHQLLTRYLKQFHLTPVMSQEEVEHWFYPQENIIDTFVVENANGEVTDFLSFYTLPSTIMNHPTHKSLKAAYSFYNVHTQTPLLDLMSDALVLAKMKGFDVFNALDLMENKTFLEKLKFGIGDGNLQYYLYNWKCPSMGAEKVGLVLQ

SEQ ID NO: 978 - protein, 359 aa, Homo sapiens
MAEPFLSEYQHQPQTSNCTGAAAVQEELNPERPPGAEERVPEEDSRWQSRAFPQLGGRPGPEGEGSLESQPPPLQTQACPESSCLREGEKGQNGDDSSAGGDFPPPAEVEPTPEAELLAQPCHDSEASKLGAPAAGGEEEWGQQQRQLGKKKHRRRPSKKKRHWKPYYKLTWEEKKKFDEKQSLRASRIRAEMFAKGQPVAPYNTTQFLMDDHDQEEPDLKTGLYSKRAAAKSDDTSDDDFMEEGGEEDGGSDGMGGDGSEFLQRDFSETYERYHTESLQNMSKQELIKEYLELEKCLSRMEDENNRLRLESKRLGGDDARVRELELELDRLRAENLQLLTENELHRQQERAPLSKFGD

SEQ ID NO: 979 - protein, 158 aa, Homo sapiens
MTHRTPKVKKSPKFRKKSYLSRLMLANRPPFSAAKSLINSPSQGAFSSLGDLSPQENPFLEVSAPSEHFIETTNIKDTTARNALEENVFMENTNMPEVTISENTNYNHPPEADSAGTAFNLGPTVKQTETKWEYNNVGTDLSPEPKSFNYPLLSLKFS

SEQ ID NO: 980 - protein, 133 aa, Homo sapiens
MGNIFEKLFKSLLGKKKMRILILSLDTAGKTTILYKLKLGETVPAVPTVGFCVETVEYKNNTFAVWDVGSHFKIGPLWQHFFQNTKELSASQFAQFIKKLCGVTGTNDEASPGKLNFLSIPSLGQMMPVNYFE

SEQ ID NO: 981 - protein, 1606 aa, Homo sapiens
MPAPPQESTENLVPFLDTWDSAGEQPLEPEQFLASQQDLKDKLSPQERLPVSPKKLKKDPAQRWSLAEIIGITRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVSPMEHELSISEQQQPVQPSESSREVESSLTQQETPGQPPEHHEVTVSPPGHHQTHHLDSPSVSVKPPDVQLTIAAEPSAEVGTSLVHQEATARLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESMTEVELSPTMKETPTQPPKKVVPQLRVYQGVTNPTPGQDQAQHPVSPSVTVQLLDLGLTITPEPTTEVGHSTAPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPHPDRVQTLHQSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLTSPAPREVEQPHTQQGPEKLAGNAVYTKPSFTQEHKAAVSVLKPFSKGAPSTSSPAKALPQVRDRSKDLTHAISILESAKARVTNTKTSKPIVHARKKYRFHKTRSHVTHRTTKVKKSPKVRKKSYLSRLMLANRLPFSAAKSLINSPSQGAFSSLGDLSPQENPFLEVSALSEHFIGKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRGIFRFLPWRGCSSRRESQDGLSSFGQPLWFKDLYKPLSATRINNHAWKLHKKSSNEDKILNRDPGDSEAPTEGEESEALP

SEQ ID NO: 982 - protein, 744 aa, Homo sapiens
MAGRSMQAARCPTDELSLTNCSVVNEKDFQSGQHVIVRTSPNHRYTFTLKTHPSVVPGSIAFSLPQRKWAGLSIGQEIEVSLYTFDKAKQCIGTMTIEIDFLQKKSNDSNPYDTDKMAAEFIQQFNNQAYSVGQQLVFSFNEKLFGLLVKDIESMDPSILKGEPATGKRQKIEVGLVVGNSQVAFEKAENSSLNLIGKAKTKENRQSIINPDWNFEKMGIGGLDKEFSDIFRRAFAFRVFPPEIVEQMGCIHVKGILLYGPPGCGKTLLARQIGKMLNAREPKVVNGPEILNKYVGESEANIRKLFADAEEEQRRLGANSGLHIIIFDEIDAICKQRGSMAGSTGVHDTVVNQLLSKIDGVEQLNNILVIGMTNRPDLIDEALLRPGRLEVKMEIGLPDEKGRLQILHIHTARMRGHQLLSADVDIKELAVETKNFSGAELEGLVRAAQSTAMNRHIKASTKVEVDMEKAESLQVTRGDFLASLENDIKPAFGTNQEDYASYIMNGIIKWGDPVTRVLDDGELLVQQTKNSDRTPLVSVLLEGPPHSGKTALAAKIAEESNFPFIKICSPDKMIGFSETAKCQAMKKIFDDAYKSQLSCVVVDDIERLLDYVPIGPRFSNLVLQALLVLLKKAPPQGRKLLIIGTTSRKDVLQEMEMLNAFSTTIHVPNIATGEQLLEALELLGNLKDKERTTIAQQVKGKKVWIGIKKLLMLIEMSLQMDPEYRVRKFLALLREEGASPLDFD

SEQ ID NO: 983 - protein, 355 aa, Homo sapiens
MEPHLLGLLLGLLLGGTRVLAGYPIWWSLALGQQYTSLGSQPLLCGSIPGLVPKQLRFCRNYIEIMPSVAEGVKLGIQECQHQFRGRRWNCTTIDDSLAIFGPVLDKATRESAFVHAIASAGVAFAVTRSCAEGTSTICGCDSHHKGPPGEGWKWGGCSEDADFGVLVSREFADARENRPDARSAMNKHNNEAGRTTILDHMHLKCKCHGLSGSCEVKTCWWAQPDFRAIGDFLKDKYDSASEMVVEKHRESRGWVETLRAKYSLFKPPTERDLVYYENSPNFCEPNPETGSFGTRDRTCNVTSHGIDGCDLLCCGRGHNTRTEKRKEKCHCIFHWCCYVSCQECIRIYDVHTCK

SEQ ID NO: 984 - protein, 212 aa, Homo sapiens
MDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKGTQKKILDIANMLGLSNTVMRLIEKRAFQDKYFMIGGMLLTCVVMFLVVQYLT

SEQ ID NO: 985 - protein, 213 aa, Homo sapiens
MDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKGTQKKILDIANMLGLSNTVMRLIEKRAFQDKYFMIGTQGSCQTAHFGGRSAGSS

SEQ ID NO: 986 - protein, 875 aa, Homo sapiens
MPEKRPFERLPADVSPINYSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVPKDRVALSNMNVIDRKPYPDDENLVEVKFARTPVMSTYLVAFVVGEYDFVETRSKDGVCVRVYTPVGKAEQGKFALEVAAKTLPFYKDYFNVPYPLPKIDLIAIADFAAGAMENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAATEDLWESLENASGKPIAAVMNTWTKQMGFPLIYVEAEQVEDDRLLRLSQKKFCAGGSYVGEDCPQWMVPITISTSEDPNQAKLKILMDKPEMNVVLKNVKPDQWVKLNLGTVGFYRTQYSSAMLESLLPGIRDLSLPPVDRLGLQNDLFSLARAGIISTVEVLKVMEAFVNEPNYTVWSDLSCNLGILSTLLSHTDFYEEIQEFVKDVFSPIGERLGWDPKPGEGHLDALLRGLVLGKLGKAGHKATLEEARRRFKDHVEGKQILSADLRSPVYLTVLKHGDGTTLDIMLKLHKQADMQEEKNRIERVLGATLLPDLIQKVLTFALSEEVRPQDTVSVIGGVAGGSKHGRKAAWKFIKDNWEELYNRYQGGFLISRLIKLSVEGFAVDKMAGEVKAFFESHPAPSAERTIQQCCENILLNAAWLKRDAESIHQYLLQRKASPPTV

SEQ ID NO: 987 - protein, 876 aa, Homo sapiens
MELITILEKTVSPDRLELEAAQKFLERAAVENLPTFLVELSRVLANPGNSQVARVAAGLQIKNSLTSKDPDIKAQYQQRWLAIDANARREVKNYVLQTLGTETYRPSSASQCVAGIACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETYMGPALFAITIEAMKSDIDEVALQGIEFWSNVCDEEMDLAIEASEAAEQGRPPEHTSKFYAKGALQYLVPILTQTLTKQDENDDDDDWNPCKAAGVCLMLLATCCEDDIVPHVLPFIKEHIKNPDWRYRDAAVMAFGCILEGPEPSQLKPLVIQAMPTLIELMKDPSVVVRDTAAWTVGRICELLPEAAINDVYLAPLLQCLIEGLSAEPRVASNVCWAFSSLAEAAYEAADVADDQEEPATYCLSSSFELIVQKLLETTDRPDGHQNNLRSSAYESLMEIVKNSAKDCYPAVQKTTLVIMERLQQVLQMESHIQSTSDRIQFNDLQSLLCATLQNVLRKVQHQDALQISDVVMASLLRMFQSTAGSGGVQEDALMAVSTLVEVLGGEFLKYMEAFKPFLGIGLKNYAEYQVCLAAVGLVGDLCRALQSNIIPFCDEVMQLLLENLGNENVHRSVKPQILSVFGDIALAIGGEFKKYLEVVLNTLQQASQAQVDKSDYDMVDYLNELRESCLEAYTGIVQGLKGDQENVHPDVMLVQPRVEFILSFIDHIAGDEDHTDGVVACAAGLIGDLCTAFGKDVLKLVEARPMIHELLTEGRRSKTNKAKTLATWATKELRKLKNQA

SEQ ID NO: 988 - protein, 261 aa, Homo sapiens
MTCWLRGVTATFGRPAEWPGYLSHLCGRSAAMDLGPMRKSYRGDREAFEETHLTSLDPVKQFAAWFEEAVQCPDIGEANAMCLATCTRDGKPSARMLLLKGFGKDGFRFFTNFESRKGKELDSNPFASLVFYWEPLNRQVRVEGPVKKLPEEEAECYFHSRPKSSQIGAVVSHQSSVIPDREYLRKKNEELEQLYQDQEVPKPKSWGGYVLYPQVMEFWQGQTNRLHDRIVFRRGLPTGDSPLGPMTHRGEEDWLYERLAP

SEQ ID NO: 989 - protein, 185 aa, Homo sapiens
MGKKQNKKKVEEVLEEEEEEYVVEKVLDRRVVKGKVEYLLKWKGFSDEDNTWEPEENLDCPDLIAEFLQSQKTAHETDKSEGGKRKADSDSEDKGEESKPKKKKEESEKPRGFARGLEPERIIGATDSSGELMFLMKWKNSDEADLVPAKEANVKCPQVVISFYEERLTWHSYPSEDDDKKDDKN

SEQ ID NO: 990 - protein, 270 aa, Homo sapiens
MGFWCRMSENQEQEEVITVRVQDPRVQNEGSWNSYVDYKIFLHTNSKAFTAKTSCVRRRYREFVWLRKQLQRNAGLVPVPELPGKSTFFGTSDEFIEKRRQGLQHFLEKVLQSVVLLSDSQLHLFLQSQLSVPEIEACVQGRSTMTVSDAILRYAMSNCGWAQEERQSSSHLAKGDQPKSCCFLPRSGRRSSPSPPPSEEKDHLEVWAPVVDSEVPSLESPTLPPLSSPLCCDFGRPKEGTSTLQSVRRAVGGDHAVPLDPGQLETVLEK

SEQ ID NO: 991 - protein, 270 aa, Homo sapiens; identical to SEQ ID NO: 990

SEQ ID NO: 992 - protein, 270 aa, Homo sapiens; identical to SEQ ID NO: 990

SEQ ID NO: 993 - protein, 270 aa, Homo sapiens; identical to SEQ ID NO: 990

SEQ ID NO: 994 - protein, 136 aa, Homo sapiens
MQTAGALFISPALIRCCTRGLIRPVSASFLNSPVNSSKQPSYSNFPLQVARREFQTSVVSRDIDTAAKFIGAGAATVGVAGSGAGIGTVFGSLIIGYARNPSLKQQLFSYAILGFALSEAMGLFCLMVAFLILFAM

SEQ ID NO: 995 - protein, 246 aa, Homo sapiens
MSIYKEPPPGMFVVPDTVDMTKIHALITGPFDTPYEGGFFLFVFRCPPDYPIHPPRVKLMTTGNNTVRFNPNFYRNGKVCLSILGTWTGPAWSPAQSISSVLISIQSLMTENPYHNEPGFEQERHPGDSKNYNECIRHETIRVAVCDMMEGKCPCPEPLRGVMEKSFLEYYDFYEVACKDRLHLQGQTMQDPFGEKRGHFDYQSLLMRLGLIRQKVLERLHNENAEMDSDSSSSGTETDLHGSLRV

SEQ ID NO: 996 - protein, 258 aa, Homo sapiens
MHRRGVGAGAIAKKKLAEAKYKERGTVLAEDQLAQMSKQLDMFKTNLEEFASKHKQEIRKNPEFRVQFQDMCATIGVDPLASGKGFWSEMLGVGDFYYELGVQIIEVCLALKHRNGGLITLEELHQQVLKGRGKFAQDVSQDDLIRAIKKLKALGTGFGIIPVGGTYLIQSVPAELNMDHTVVLQLAEKNGYVTVSEIKASLKWETERARQVLEHLLKEGLAWLDLQAPGEAHYWLPALFTDLYSQEITAEEAREALP

SEQ ID NO: 997 - protein, 606 aa, Homo sapiens
MSHTASSCQELVENCAVHVAGMAQEDSRRGQVPSSFYHGANQELDLSTKVYKRESGSPYSVLVDTKMSKPHLHETEEQPYFRETRAVSDVHAVKEDRENSDDTEEEEEEVSYKREQIIVEVNLNNQTLNVSKGEKGVSSQSKETPVLKTSSEEEEEESEEEATDDSNDYGENEKQKKKEKIVEKVSVTQRRTRRAASVAAATTSPTPRTTRGRRKSVEPPKRKKRATKEPKAPVQKAKCEEKETLTCEKCPRVFNTRWYLEKHMNVTHRRMQICDKCGKKFVLESELSLHQQTDCEKNIQCVSCNKSFKKLWSLHEHIKIVHGYAEKKFSCEICEKKFYTMAHVRKHMVAHTKDMPFTCETCGKSFKRSMSLKVHSLQHSGEKPFRCENCDERFQYKYQLRSHMSIHIGHKQFMCQWCGKDFNMKQYFDEHMKTHTGEKPFICEICGKSFTSRPNMKRHRRTHTGEKPYPCDVCGQRFRFSNMLKAHKEKCFRVTSPVNVPPAVQIPLTTSPATPVPSVVNTATTPTPPINMNPVSTLPPRPIPHPFSHLHIHPHPHHPHHLPIPPVPHLPPPPALFKSEPLNHRGQSEDNFLRHLAEKNSSAQHH

SEQ ID NO: 998 - protein, 272 aa, Homo sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVEKAEQQKKAAIISAEGDSKAAELIANSLATAGDGLIELRKLEAAEDIAYQLSRSRNITYLPAGQSVLLQLPQ

SEQ ID NO: 999 - protein, 374 aa, Homo sapiens
MSRVPSPPPPAEMSSGPVAESWCYTQIKVVKFSYMWTINNFSFCREEMGEVIKSSTFSSGANDKLKWCLRVNPKGLDEESKDYLSLYLLLVSCPKSEVRAKFKFSILNAKGEETKAMESQRAYRFVQGKDWGFKKFIRRDFLLDEANGLLPDDKLTLFCEVSVVQDSVNISGQNTMNMVKVPECRLADELGGLWENSRFTDCCLCVAGQEFQAHKAILAARSPVFSAMFEHEMEESKKNRVEINDVEPEVFKEMMCFIYTGKAPNLDKMADDLLAAADKYALERLKVMCEDALCSNLSVENAAEILILADLHSADQLKTQAVDFINYHASDVLETSGWKSMVVSHPHLVAEAYRSLASAQCPFLGPPRKRLKQS

SEQ ID NO: 1000 - protein, 322 aa, Homo sapiens
MASSSSLVPDRLRLPLCFLGVFVCYFYYGILQEKITRGKYGEGAKQETFTFALTLVFIQCVINAVFAKILIQFFDTARVDRTRSWLYAACSISYLGAMVSSNSALQFVNYPTQVLGKSCKPIPVMLLGVTLLKKKYPLAKYLCVLLIVAGVALFMYKPKKVVGIEEHTVGYGELLLLLSLTLDGLTGVSQDHMRAHYQTGSNHMMLNINLWSTLLLGMGILFTGELWEFLSFAERYPAIIYNILLFGLTSALGQSFIFMTVVYFGPLTCSIITTTRKFFTILASVILFANPISPMQWVGTVLVFLGLGLDAKFGKGAKKTSH

SEQ ID NO: 1001 - protein, 453 aa, Homo sapiens
MAGAAAGGRGGGAWGPGRGGAGGLRRGCSPPAPAGSPRAGLQPLRATIPFQLQQPHQRRDGGGRAASVPCSVAPEKSVCRPQPLQVRRTFSLDTILSSYLLGQWPRDADGAFTCCTNDKATQTPLSWQELEGERASSCAHKRSASWGSTDHRKEISKLKQQLQRTKLSRSGKEKERGSPLLGDHAVRGALRASPPSFPSGSPVLRLSPCLHRSLEGLNQELEEVFVKEQGEEELLRILDIPDGHRAPAPPQSGSCDHPLLLLEPGNLASSPSMSLASPQPCGLASHEEHRGAAEELASTPNDKASSPGHPAFLEDGSPSPVLAFAASPRPNHSYIFKREPPEGCEKVRVFEEATSPGPDLAFLTSCPDKNKVHFNPTGSAFCPVNLMKPLFPGMGFIFRNCPSNPGSPLPPASPRPPPRKDPEASKASPLPFEPWQRTPPSEEPVLFQSSLMV

SEQ ID NO: 1002 - protein, 611 aa, Homo sapiens
MPRRKRNAGSSSDGTEDSDFSTDLEHTDSSESDGTSRRSARVTRSSARLSQSSQDSSPVRNLQSFGTEEPAYSTRRVTRSQQQPTPVTPKKYPLRQTRSSGSETEQVVDFSDRETKNTADHDESPPRTPTGNAPSSESDIDISSPNVSHDESIAKDMSLKDSGSDLSHRPKRRRFHESYNFNMKCPTPGCNSLGHLTGKHERHFSISGCPLYHNLSADECKVRAQSRDKQIEERMLSHRQDDNNRHATRHQAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 1003 - protein, 1051 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRARTRALYEAKRQKAEMKSQPSETERLTDDY

SEQ ID NO: 1004 - protein, 1066 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCDFFKRTRYYQIMPKYHAVRIREEERYPPPGSTLPTKKHWVTSWQTRDQYY

SEQ ID NO: 1005 - protein, 407 aa, Homo sapiens
MRWVWALLKNASLAGAPKYIEHFSKFSPSPLSMKQFLDFGSSNACEKTSFTFLRQELPVRLANIMKEINLLPDRVLSTPSVQLVQSWYVQSLLDIMEFLDKDPEDHRTLSQFTDALVTIRNRHNDVVPTMAQGVLEYKDTYGDDPVSNQNIQYFLDRFYLSRISIRMLINQHTLIFDGSTNPAHPKHIGSIDPNCNVSEVVKDAYDMAKLLCDKYYMASPDLEIQEINAANSKQPIHMVYVPSHLYHMLFELFKNAMRATVESHESSLILPPIKVMVALGEEDLSIKMSDRGGGVPLRKIERLFSYMYSTAPTPQPGTGGTPLAGFGYGLPISRLYAKYFQGDLQLFSMEGFGTDAVIYLKALSTDSVERLPVYNKSAWRHYQTIQEAGDWCVPSTEPKNTSTYRVS

SEQ ID NO: 1006 - protein, 865 aa, Homo sapiens
MVASARVQKLVRRYKLAIATALAILLLQGLVVWSFSGLEEDEAGEKGRQRKPRPLDPGEGSKDTDSSAGRRGSTGRRHGRWRGRAESPGVPVAKVVRAVTSRQRASRRVPPAPPPEAPGRQNLSGAAAGEALVGAAGFPPHGDTGSVEGAPQPTDNGFTPKCEIVGKDALSALARASTKQCQQEIANVVCLHQAGSLMPKAVPRHCQLTGKMSPGIQWDESQAQQPMDGPPVRIAYMLVVHGRAIRQLKRLLKAVYHEQHFFYIHVDKRSDYLHREVVELAQGYDNVRVTPWRMVTIWGGASLLTMYLRSMRDLLEVPGWAWDFFINLSATDYPTRTNEELVAFLSKNRDKNFLKSHGRDNSRFIKKQGLDRLFHECDSHMWRLGERQIPAGIVVDGGSDWFVLTRSFVEYVVYTDDPLVAQLRQFYTYTLLPAESFFHTVLENSLACETLVDNNLRVTNWNRKLGCKCQYKHIVDWCGCSPNDFKPQDFLRLQQVSRPTFFARKFESTVNQEVLEILDFHLYGSYPPGTPALKAYWENTYDAADGPSGLSDVMLTAYTAFARLSLHHAATAAPPMGTPLCRFEPRGLPSSVHLYFYDDHFQGYLVTQAVQPSAQGPAETLEMWLMPQGSLKLLGRSDQASRLQSLEVGTDWDPKERLFRNFGGLLGPLDEPVAVQRWARGPNLTATVVWIDPTYVVATSYDITVDTETEVTQYKPPLSRPLRPGPWTVRLLQFWEPLGETRFLVLPLTFNRKLPLRKDDASWLHAGPPHNEYMEQSFQGLSSILNLPQPELAEEAAQRHTQLTGPALEAWTDRELSSFWSVAGLCAIGPSPCPSLEPCRLTSWSSLSPDPKSELGPVKADGRLR

SEQ ID NO: 1007 - protein, 307 aa, Homo sapiens
MTKAGSKGGNLRDKLDGNELDLSLSDLNEVPVKELAALPKATILDLSCNKLTTLPSDFCGLTHLVKLDLSKNKLQQLPADFGRLVNLQHLDLLNNKLVTLPVSFAQLKNLKWLDLKDNPLDPVLAKVAGDCLDEKQCKQCANKVLQHMKAVQADQERERQRRLEVEREAEKKREAKQRAKEAQERELRKREKAEEKERRRKEYDALKAAKREQEKKPKKEANQAPKSKSGSRPRKPPPRKHTRSWAVLKLLLLLLLFGVAGGLVACRVTELQQQPLCTSVNTIYDNAVQGLRRHEILQWVLQTDSQQ

SEQ ID NO: 1008 - protein, 615 aa, Homo sapiens
MAVYVGMLRLGRLCAGSSGVLGARAALSRSWQEARLQGVRFLSSREVDRMVSTPIGGLSYVQGCTKKHLNSKTVVQCLETTAQRVPEREALVVLHEDVRLTFAQLKEEVDKAASGLLSIGLCKGDRLGMWGPNSYAWVLMQLATAQAGIILVSVNPAYQAMELEYVLKKVGCKALVFPKQFKTQQYYNVLKQICPEVENAQPGALKSQRLPDLTTVISVDAPLPGTLLLDEVVAAGSTRQHLDQLQYNQQFLSCHDPINIQFTSGTTGSPKGATLSHYNIVNNSNILGERLKLHEKTPEQLRMILPNPLYHCLGSVAGTMMCLMYGATLILASPIFNGKKALEAISRERGTFLYGTPTMFVDILNQPDFSSYDISTMCGGVIAGSPAPPELIRAIINKINMKDLVVAYGTTENSPVTFAHFPEDTVEQKAESVGRIMPHTEARIMNMEAGTLAKLNTPGELCIRGYCVMLGYWGEPQKTEEAVDQDKWYWTGDVATMNEQGFCKIVGRSKDMIIRGGENIYPAELEDFFHTHPKVQEVQVVGVKDDRMGEEICACIRLKDGEETTVEEIKAFCKGKISHFKIPKYIVFVTNYPLTISGKIQKFKLREQMERHLNL

SEQ ID NO: 1009 - protein, 442 aa, Homo sapiens
MALPGARARGWAAAARAAQRRRRVENAGGSPSPEPAGRRAALYVHWPYCEKRCSYCNFNKYIPRRLEEAAMQKCLVTEAQTLLRLSGVQRVESVFFGGGTPSLASPHTVAAVLEAVAQAAHLPADLEVTLEANPTSAPGSRLAEFGAAGVNRLSIGLQSLDDTELRLLGRTHSACDALRTLAEARRLFPGRVSVDLMLGLPAQQVGPWLGQLQELLHHCDDHLSLYQLSLERGTALFAQVQRGALPAPDPELAAEMYQRGRAVLREAGFHQYEVSNFARNGALSTHNWTYWQCGQYLGVGPGAHGRFMPQGAGGHTREARIQTLEPDNWMKEVMLFGHGTRKRVPLGRLELLEEVLALGLRTDVGITHQHWQQFEPQLTLWDVFGANKEVQELLERGLLQLDHRGLRCSWEGLAVLDSLLLTLLPQLQEAWQQRTPSPVPGG

SEQ ID NO: 1010 - protein, 632 aa, Homo sapiens
MTTSALRRQVKNIVHNYSEAEIKVREATSNDPWGPPSSLMSEIADLTFNTVAFTEVMGMLWRRLNDSGKNWRHVYKALTLLDYLLKTGSERVAHQCRENLYTIQTLKDFQYIDRDGKDQGVNVREKVKQVMALLKDEERLRQERTHALKTKERMALEGIGIGSGQLGFSRRYGEDYSRSRGSPSSYNSSSSSPRYTSDLEQARPQTSGEEELQLQLALAMSREEAEKPVPPASHRDEDLQLQLALRLSRQEHEKEVRSWQGDGSPMANGAGAVVHHQRDREPEREERKEEEKLKTSQSSILDLADIFVPALAPPSTHCSADPWDIPGFRPNTEASGSSWGPSADPWSPIPSGTVLSRSQPWDLTPMLSSSEPWGRTPVLPAGPPTTDPWALNSPHYKLPSTGADPWGASLETSDTPGGASTFDPFAKPPESTETKEGLEQALPSGKPSSPVELDLFGDPSPSSKQNGTKEPDALDLGILGEALTQPSKEARACRTPESFLGPSASSLVNLDSLVKAPQVAKTRNPFLTGLSAPSPTNPFGAGETGRPTLNQMRTGSPALGLAGGPVGAPLGSMTYSASLPLPLSSVPAGLTLPASVSVFPQAGAFAPQPLLPTPSSAGPRPPPPQTGTNPFL

SEQ ID NO: 1011 - protein, 802 aa, Homo sapiens
MLGARAWLGRVLLLPRAGAGLAASRRCPGVWPRTWPHRSPSRGSSSRDKDRSATVSSSVPMPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNGLMVSGYAVTGAVLGQDRLINYATNGAKFLKRHMFDVASGRLMRTCYTGPGGTVEHSNPPCWGFLEDYAFVVRGLLDLYEASQESAWLEWALRLQDTQDKLFWDSQGGGYFCSEAELGAGLPLRLKDDQDGAEPSANSVSAHNLLRLHGFTGHKDWMDKCVCLLTAFSERMRRVPVALPEMVRALSAQQQTLKQIVICGDRQAKDTKALVQCVHSVYIPNKVLILADGDPSSFLSRQLPFLSTLRRLEDQATAYVCENQACSVPITDPCELRKLLHP

SEQ ID NO: 1012 - protein, 368 aa, Homo sapiens
MNALLEQKEQQERLREAAALGDIREVQKLVESGVDVNSQNEVNGWTCLHWACKRNHGQVVSYLLKSGADKEILTTKGEMPVQLTSRREIRKIMGVEEEDDDDDDDDNLPQLKKESELPFVPNYLANPAFPFIYTPTAEDSAQMQNGGPSTPPASPPADGSPPLLPPGEPPLLGTFPRDHTSLALVQNGDVSAPSAILRTPESTKPGPVCQPPVSQSRSLFSSVPSKPPMSLEPQNGTYAGPAPAFQPFFFTGAFPFNMQELVLKVRIQNPSLRENDFIEIELDRQELTYQELLRVCCCELGVNPDQVEKIRKLPNTLLRKDKDVARLQDFQELELVLMISENNFLFRNAASTLTERPCYNRRASKLTY

SEQ ID NO: 1013 - protein, 432 aa, Homo sapiens
MISAAQLLDELMGRDRNLAPDEKRSNVRWDHESVCKYYLCGFCPAELFTNTRSDLGPCEKIHDENLRKQYEKSSRFMKVGYERDFLRYLQSLLAEVERRIRRGHARLALSQNQQSSGAAGPTGKNEEKIQVLTDKIDVLLQQIEELGSEGKVEEAQGMMKLVEQLKEERELLRSTTSTIESFAAQEKQMEVCEVCGAFLIVGDAQSRVDDHLMGKQHMGYAKIKATVEELKEKLRKRTEEPDRDERLKKEKQEREEREKEREREREERERKRRREEEEREKERARDRERRKRSRSRSRHSSRTSDRRCSRSRDHKRSRSRERRRSRSRDRRRSRSHDRSERKHRSRSRDRRRSKSRDRKSYKHRSKSRDREQDRKSKEKEKRGSDDKKSSVKSGSREKQSEDTNTESKESDTKNEVNGTSEDIKSEGDTQSN

SEQ ID NO: 1014 - protein, 432 aa, Homo sapiens; identical to SEQ ID NO: 1013

SEQ ID NO: 1015 - protein, 1307 aa, Homo sapiens
MELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETNKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 1016 - protein, 734 aa, Homo sapiens
MSPGCMLLFVFGFVGGAVVINSAILVSLSVLLLVHFSISTGVPALTQNLPRILRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEESSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVHSSLGDGARPCLKTDKQAKNRLKSGFH

SEQ ID NO: 1017 - protein, 152 aa, Homo sapiens
MANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 1018 - protein, 177 aa, Homo sapiens
MVLLSTLGIVFQGEGPPISSCDTGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 1019 - protein, 152 aa, Homo sapiens
MANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHDWVYE

SEQ ID NO: 1020 - protein, 521 aa, Homo sapiens
MRPDWKAGAGPGGPPQKPAPSSQRKPPARPSAAAAAIAVAAAEEERRLRQRNRLRLEEDKPAVERCLEELVFGDVENDEDALLRRLRGPRVQEHEDSGDSEVENEAKGNFPPQKKPVWVDEEDEDEEMVDMMNNRFRKDMMKNASESKLSKDNLKKRLKEEFQHAMGGVPAWAETTKRKTSSDDESEEDEDDLLQRTGNFISTSTSLPRGILKMKNCQHANAERPTVARISSVQFHPGAQIVMVAGLDNAVSLFQVDGKTNPKIQSIYLERFPIFKACFSANGEEVLATSTHSKVLYVYDMLAGKLIPVHQVRGLKEKIVRSFEVSPDGSFLLINGIAGYLHLLAMKTKELIGSMKINGRVAASTFSSDSKKVYASSGDGEVYVWDVNSRKCLNRFVDEGSLYGLSIATSRNGQYVACGSNCGVVNIYNQDSCLQETNPKPIKAIMNLVTGVTSLTFNPTTEILAIASEKMKEAVRLVHLPSCTVFSNFPVIKNKNISHVHTMDFSPRSGYFALGNEKARP

SEQ ID NO: 1021 - protein, 276 aa, Homo sapiens
MGGLWRPGWRCVPFCGWRWIHPGSPTRAAERVEPFLRPEWSGTGGAERGLRWLGTWKRCSLRARHPALQPPRRPKSSNPFTRAQEEERRRQNKTTLTYVAAVAVGMLGASYAAVPLYRLYCQTTGLGGSAVAGHASDKIENMVPVKDRIIKISFNADVHASLQWNFRPQQTEIYVVPGETALAFYRAKNPTDKPVIGISTYNIVPFEAGQYFNKIQCFCFEEQRLNPQEEVDMPVFFYIDPEFAEDPRMIKVDLITLSYTFFEAKEGHKLPVPGYN

SEQ ID NO: 1022 - protein, 295 aa, Homo sapiens
MEKMSRPLPLNPTFIPPPYGVLRSLLENPLKLPLHHEDAFSKDKDKEKKLDDESNSPTVPQSAFLGPTLWDKTLPYDGDTFQLEYMDLEEFLSENGIPPSPSQHDHSPHPPGLQPASSAAPSVMDLSSRASAPLHPGIPSPNCMQSPIRPGQLLPANRNTPSPIDPDTIQVPVGYEPDPADLALSSIPGQEMFDPRKRKFSEEELKPQPMIKKARKVFIPDDLKDDKYWARRRKNNMAAKRSRDARRLKENQIAIRASFLEKENSALRQEVADLRKELGKCKNILAKYEARHGPL

SEQ ID NO: 1023 - protein, 214 aa, Homo sapiens
MELAAGSFSEEQFWEACAELQQPALAGADWQLLVETSGISIYRLLDKKTGLHEYKVFGVLEDCSPTLLADIYMDSDYRKQWDQYVKELYEQECNGETVVYWEVKYPFPMSNRDYVYLRQRRDLDMEGRKIHVILARSTSMPQLGERSGVIRVKQYKQSLAIESDGKKGSKVFMYYFDNPGGQIPSWLINWAAKNGVPNFLKDMARACQNYLKKT

SEQ ID NO: 1024 - protein, 1356 aa, Homo sapiens
MDLKEKHLGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKRREVERRLRGIIDQIQDALRDGREIQWPSAMYPDLHMPFAPSWSLHWAYRDGHLVNLPVSLLVEGDIIALRPGQESFASLRGMKDDEHIVLEPGDLFPPFSPPPSPRGEVERGPQSPQQHRLFRVLETPVIDNIRWCLDMALSRPVTALDNERFTVQSVMLHYAVPVVLAGFLITNALRFIFSAPGVTSWQYTLLQLQVNGVLPILPLLFPVLWVLATACGEARVLAQMSKASPSSLLAKFSEDTLSSYTEAVSSQEMLRCIWGHFLRVLGGTSPTLSHSSSLLHSLGSVTVLCCVDKQGILSWPNPSPETVLFFSGKVEPPHSSHEDLTDGLSTRSFCHPEPHERDALLAGSLNNTLHLSNEQERGDWPGEAPKPPEPYSHHKAHGRSKHPSGSNVSFSRDTEGGEEEPSKTQPGMESDPYEAEDFVCDYHLEMLSLSQDQQNPSCIQFDDSNWQLHLTSLKPLGLNVLLNLCDASVTERLCRFSDHLCNIALQESHSAVLPVHVPWGLCELARLIGFTPGAKELFKQENHLALYRLPSAETMKETSLGRLSCVTKRRPPLSHMISLFIKDTTTSTEQMLSHGTADVVLEACTDFWDGADIYPLSGSDRKKVLDFYQRACLSGYCSAFAYKPMNCALSSQLNGKCIELVQVPGQSSIFTMCELPSTIPIKQNARRSSWSSDEGIGEVLEKEDCMQALSGQIFMGMVSSQYQARLDIVRLIDGLVNACIRFVYFSLEDELKSKVFAEKMGLETGWNCHISLTPNGDMPGSEIPPSSPSHAGSLHDDLNQVSRDDAEGLLLMEEEGHSDLISFQPTDSDIPSFLEDSNRAKLPRGIHQVRPHLQNIDNVPLLVPLFTDCTPETMCEMIKIMLEYGEVTCCLGSSANLRNSCLFLQSDISIALDPLYPSRCSWETFGYATSISMAQASDGLSPLQLSGQLNSLPCSLTFRQEETISIIRLIEQARHATYGIRKCFLFLLQCQLTLVVIQFLSCLVQLPPLLSTTDILWLSCFCYPLLSISLLGKPPHSSIMSMATGKNLQSIPKKTQHYFLLCFLLKFSLTISSCLICFGFTLQSFCDSSRDRNLTNCSSVMLPSNDDRAPAWFEDFANGLLSAQKLTAALIVLHTVFISITHVHRTKPLWRKSPLTNLWWAVTVPVVLLGQVVQTAVDLQLWTHRDSHVHFGLEDVPLLTWLLGCLSLVLVVVTNEIVKLHEIRVRVRYQKRQKLQFETKLGMNSPF

SEQ ID NO: 1025 - protein, 1202 aa, Homo sapiens
MGREQDLILAVKNGDVTGVQKLVAKVKATKTKLLGSTKRLNVNYQDADGFSALHHAALGGSLELIALLLEAQATVDIKDSNGMRPLHYAAWQGRLEPVRLLLRASAAVNAASLDGQIPLHLAAQYGHYEVSEMLLQHQSNPCLVNKAKKTPLDLACEFGRLKVAQLLLNSHLCVALLEGEAKDPCDPNYTTPLHLAAKNGHREVIRQLLRAGIEINRQTKTGTALHEAALYGKTEVVRLLLEGGVDVNIRNTYNQTALDIVNQFTTSQASREIKQLLREASGILKVRALKDFWNLHDPTALNVRAGDVITVLEQHPDGRWKGHIHESQRGTDRIGYFPPGIVEVVSKRVGIPAARLPSAPTPLRPGFSRTPQPPAEEPPHPLTYSQLPRVGLSPDSPAGDRNSVGSEGSVGSIRSAGSGQSSEGTNGHGPGLLIENAQPLPSAGEDQVLPGLHPPSLADNLSHRPLANCRSGEQIFTQDVRPEQLLEGKDAQAIHNWLSEFQLEGYTAHFLQAGYDVPTISRMTPEDLTAIGVTKPGHRKKIASEIAQLSIAEWLPSYIPTDLLEWLCALGLPQYHKQLVSSGYDSMGLVADLTWEELQEIGVNKLGHQKKLMLGVKRLAELRRGLLQGEALSEGGRRLAKGPELMAIEGLENGEGPATAGPRLLTFQGSELSPELQAAMAGGGPEPLPLPPARSPSQESIGARSRGSGHSQEQPAPQPSGGDPSPPQERNLPEGTERPPKLCSSLPGQGPPPYVFMYPQGSPSSPAPGPPPGAPWAFSYLAGPPATPPDPPRPKRRSHSLSRPGPTEGDAEGEAEGPVGSTLGSYATLTRRPGRSALVRTSPSVTPTPARGTPRSQSFALRARRKGPPPPPPKRLSSVSGPSPEPPPLDGSPGPKEGATGPRRRTLSEPAGPSEPPGPPAPAGPASDTEEEEPGPEGTPPSRGSSGEGLPFAEEGNLTIKQRPKPAGPPPRETPVPPGLDFNLTESDTVKRRPKCREREPLQTALLAFGVASATPGPAAPLPSPTPGESPPASSLPQPEPSSLPAQGVPTPLAPSPAMQPPVPPCPGPGLESSAASRWNGETEPPAAPAALLKVPGAGTAPKPVSVACTQLAFSGPKLAPRLGPRPVPPPRPESTGTVGPGQAQQRLEQTSSSLAAALRAAEKSIGTKEQEGTPSASTKHILDDISTMFDALADQLDAMLD

SEQ ID NO: 1026 - protein, 1202 aa, Homo sapiens; identical to SEQ ID NO: 1025

SEQ ID NO: 1027 - protein, 519 aa, Homo sapiens
MDLVGVASPEPGTAAAWGPSKCPWAIPQNTISCSLADVMSEQLAKELQLEEEAAVFPEVAVAEGPFITGENIDTSSDLMLAQMLQMEYDREYDAQLRREEKKFNGDSKVSISFENYRKVHPYEDSDSSEDEVDWQDTRDDPYRPAKPVPTPKKGFIGKGKDITTKHDEVVCGRKNTARMENFAPEFQVGDGIGMDLKLSNHVFNALKQHAYSEERRSARLHEKKEHSTAEKAVDPKTRLLMYKMVNSGMLETITGCISTGKESVVFHAYGGSMEDEKEDSKVIPTECAIKVFKTTLNEFKNRDKYIKDDFRFKDRFSKLNPRKIIRMWAEKEMHNLARMQRAGIPCPTVVLLKKHILVMSFIGHDQVPAPKLKEVKLNSEEMKEAYYQTLHLMRQLYHECTLVHADLSEYNMLWHAGKVWLIDVSQSVEPTHPHGLEFLFRDCRNVSQFFQKGGVKEALSERELFNAVSGLNITADNEADFLAEIEALEKMNEDHVQKNGRKAASFLKDDGDPPLLYDE

SEQ ID NO: 1028 - protein, 424 aa, Homo sapiens
MDLVGVASPEPGTAAAWGPSKCPWAIPQNTISCSLADVMSEQLAKELQLEEEAAVFPEVAVAEGPFITGENIDTSSDLMLAQMLQMEYDREYDAQLRREEKKFNGDSKVSISFENYRKVHPYEDSDSSEDEVDWQDTRDDPYRPAKPVPTPKKGFIGKGKDITTKHDEVVCGRKNTARMENFAPEFQVGDGIGMDLKLSNHVFNALKQHAYSEERRSARLHEKKEHSTAEKAVDPKTRLLMYKMVNSGMLETITGCISTGKESVVFHAYGGSMEDEKEDSKVIPTECAIKVFKTTLNEFKNRDKYIKDDFRFKDRFSKLNPRKIIRMWAEKEMHNLARMQRAGIPCPTVVLLKKHILVMSFIGHDQVPAPKLKEVKLNSEEMKEAYYQTLHLMRQLYHECTLVHADLSEYNMLWHAGKVRSTFC

SEQ ID NO: 1029 - protein, 519 aa, Homo sapiens; identical to SEQ ID NO: 1027

SEQ ID NO: 1030 - protein, 424 aa, Homo sapiens; identical to SEQ ID NO: 1028

SEQ ID NO: 1031 - protein, 657 aa, Homo sapiens
MGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPERAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLACLLLSLESFYPPAHQLSLDMLKRLSTANDEIVEVLLSKHQVLAALRFIRGIGGHDNISARKFLDAAKQTEDNMLFYTIFRFFEQRNQRLRGSPNFTPGEHCEEHVAFFKQIFGDQALMRPTTF

SEQ ID NO: 1032 - protein, 1278 aa, Homo sapiens
MTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHIKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIGPSVNKAKSCATEERYKGTERERLLNF

SEQ ID NO: 1033 - protein, 493 aa, Homo sapiens
MISSKPRLVVPYGLKTLLEGISRAVLKTNPSNINQFAAAYFQELTMYRGNTTMDIKDLVKQFHQIKVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLGKVSSIHSDQSDVLMVDVATSMPVVIKEVPSSEAAEDVMVAAPLVCSGKVLEVQVVNQTSVHVDLGSQPKENEAEPSTASSVPLQDEQEPPAYDQAPEVTLQADIEVMSTVHISSVYNDVPVTEGVVYIEQLPEQIVIPFTDQVACLKENEQSKENEQSPRVSPKSVVEKTTSGMSKKSVESVKLAQLEENAKYSSVYMEAEATALLSDTSLKGQPEVPAQLLDAEGAIKIGSEKSLHLEVEITSIVSDNTGQEESGENSVPQEMEGKPVLSGEAAEAVHSGTSVKSSSGPFPPAPEGLTAPEIEPEGESTAE

SEQ ID NO: 1034 - protein, 281 aa, Homo sapiens
MEKSTDTDEDNVTRTEYSDKTTQFPSVYAVPGTEQTEAVGGLSSKPATPKTTTPPSSPPPTAVSPEFAYVPADPAQLAAQMLAMATSERGQPPPCSNMWTLYCLTDKNQQGHPSPPPAPGPFPQATLYLPNPKDPQFQQHPPKVTFPTYVMGDTKKTSAPPFILVGSNVQEAQGWKPLPGHAVVSQSDVLRYVAMQVPIAVPADEKYQKHTLSPQNANPPSGQDVPRPKSPVFLSVAFPVEDVAKKSSGSGDKCAPFGSYGIAGEVTVTTAHKRRKAETEN

SEQ ID NO: 1035 - protein, 379 aa, Homo sapiens
MISSKPRLVVPYGLKTLLEGISRAVLKTNPSNINQFAAAYFQELTMYRGNTTMDIKDLVKQFHQIKVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLAMATSERGQPPPCSNMWTLYCLTDKNQQGHPSPPPAPGPFPQATLYLPNPKDPQFQQHPPKVTFPTYVMGDTKKTSAPPFILVGSNVQEAQGWKPLPGHAVVSQSDVLRYVAMQVPIAVPADEKYQKHTLSPQNANPPSGQDVPRPKSPVFLSVAFPVEDVAKKSSGSGDKCAPFGSYGIAGEVTVTTAHKRRKAETEN

SEQ ID NO: 1036 - protein, 475 aa, Homo sapiens
MISSKPRLVVPYGLKTLLEGISRAVLKTNPSNINQFAAAYFQELTMYRVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLGKVSSIHSDQSDVLMVDVATSMPVVIKEVPSSEAAEDVMVAAPLVCSGKVLEVQVVNQTSVHVDLGSQPKENEAEPSTASSVPLQDEQEPPAYDQAPEVTLQADIEVMSTVHISSVYNDVPVTEGVVYIEQLPEQIVIPFTDQVACLKENEQSKENEQSPRVSPKSVVEKTTSGMSKKSVESVKLAQLEENAKYSSVYMEAEATALLSDTSLKGQPEVPAQLLDAEGAIKIGSEKSLHLEVEITSIVSDNTGQEESGENSVPQEMEGKPVLSGEAAEAVHSGTSVKSSSGPFPPAPEGLTAPEIEPEGESTAE

SEQ ID NO: 1037 - protein, 379 aa, Homo sapiens; identical to SEQ ID NO: 1035

SEQ ID NO: 1038 - protein, 221 aa, Homo sapiens
MISSKPRLVVPYGLKTLLEGISRAVLKTNPSNINQFAAAYFQELTMYRGNTTMDIKDLVKQFHQIKVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLEDVAKKSSGSGDKCAPFGSYGIAGEVTVTTAHKRRKAETEN

SEQ ID NO: 1039 - protein, 437 aa, Homo sapiens
MSEEKDCGGGDALSNGIKKHRTSLPSPMFSRNDFSIWSILRKCIGMELSKITMPVIFNEPLSFLQRLTEYMEHTYLIHKASSLSDPVERMQCVAAFAVSAVASQWERTGKPFNPLLGETYELVRDDLGFRLISEQVSHHPPISAFHAEGLNNDFIFHGSIYPKLKFWGKSVEAEPKGTITLELLEHNEAYTWTNPTCCVHNIIVGKLWIEQYGNVEIINHKTGDKCVLNFKPCGLFGKELHKVEGYIQDKSKKKLCALYGKWTECLYSVDPATFDAYKKNDKKNTEEKKNSKQMSTSEELDEMPVPDSESVFIIPGSVLLWRIAPRPPNSAQMYNFTSFAMVLNEVDKDMESVIPKTDCRLRPDIRAMENGEIDQASEEKKRLEEKQRAARKNRSKSEEDWKTRWFHQGPNPYNGAQDWIYSGSYWDRNYFNLPDIY

SEQ ID NO: 1040 - protein, 950 aa, Homo sapiens
MNTEAEQQLLHHARNGNAEEVRQLLETMARNEVIADINCKGRSKSNLGWTPLHLACYFGHRQVVQDLLKAGAEVNVLNDMGDTPLHRAAFTGRKELVMLLLEYNADTTIVNGSGQTAKEVTHAEEIRSMLEAVERTQQRKLEELLLAAAREGKTTELTALLNRPNPPDVNCSDQLGNTPLHCAAYRAHKQCALKLLRSGADPNLKNKNDQKPLDLAQGAEMKHILVGNKVIYKALKRYEGPLWKSSRFFGWRLFWVVLEHGVLSWYRKQPDAVHNIYRQGCKHLTQAVCTVKSTDSCLFFIKCFDDTIHGFRVPKNSLQQSREDWLEAIEEHSAYSTHYCSQDQLTDEEEEDTVSAADLKKSLEKAQSCQQRLDREISNFLKMIKECDMAKEMLPSFLQKVEVVSEASRETCVALTDCLNLFTKQEGVRNFKLEQEQEKNKILSEALETLATEHHELEQSLVKGSPPASILSEDEFYDALSDSESERSLSRLEAVTARSFEEEGEHLGSRKHRMSEEKDCGGGDALSNGIKKHRTSLPSPMFSRNDFSIWSILRKCIGMELSKITMPVIFNEPLSFLQRLTEYMEHTYLIHKASSLSDPVERMQCVAAFAVSAVASQWERTGKPFNPLLGETYELVRDDLGFRLISEQVSHHPPISAFHAEGLNNDFIFHGSIYPKLKFWGKSVEAEPKGTITLELLEHNEAYTWTNPTCCVHNIIVGKLWIEQYGNVEIINHKTGDKCVLNFKPCGLFGKELHKVEGYIQDKSKKKLCALYGKWTECLYSVDPATFDAYKKNDKKNTEEKKNSKQMSTSEELDEMPVPDSESVFIIPGSVLLWRIAPRPPNSAQMYNFTSFAMVLNEVDKDMESVIPKTDCRLRPDIRAMENGEIDQASEEKKRLEEKQRAARKNRSKSEEDWKTRWFHQGPNPYNGAQDWIYSGSYWDRNYFNLPDIY

SEQ ID NO: 1041 - protein, 927 aa, Homo sapiens
MNTEAEQQLLHHARNGNAEEVRQLLETMARNEVIADINCKGRSKSNLGWTPLHLACYFGHRQVVQDLLKAGAEVNVLNDMGDTPLHRAAFTGRKELVMLLLEYNADTTIVNGSGQTAKEVTHAEEIRSMLEAVERTQQRKLEELLLAAAREGKTTELTALLNRPNPPDVNCSDQLGNTPLHCAAYRAHKQCALKLLRSGADPNLKNKNDQKPLDLAQGAEMKHILVGNKVIYKALKRYEGPLWKSSRFFGWRLFWVVLEHGVLSWYRKQPDAVHNIYRQGCKHLTQAVCTVKSTDSCLFFIKCFDDTIHGFRVPKNSLQQSREDWLEAIEEHSAYSTHYCSQDQLTDEEEEDTVSAADLKKSLEKAQSCQQRLDREISNFLKMIKECDMAKEMLPSFLQKVEVVSEASRETCVALTDCLNLFTKQEGVRNFKLEQEQEKNKILSEALETLATEHHELEQSLVKGSPPASILSEDEFYDALSDSESERSLSRLEAVTARSFEEEGEHLGSRKHRMSEEKDCGGGDALSNGIKKHRTSLPSPMFSRNDFSIWSILRKCIGMELSKITMPVIFNEPLSFLQRLTEYMEHTYLIHKASSLSDPVERMQCVAAFAVSAVASQWERTGKPLVSHHPPISAFHAEGLNNDFIFHGSIYPKLKFWGKSVEAEPKGTITLELLEHNEAYTWTNPTCCVHNIIVGKLWIEQYGNVEIINHKTGDKCVLNFKPCGLFGKELHKVEGYIQDKSKKKLCALYGKWTECLYSVDPATFDAYKKNDKKNTEEKKNSKQMSTSEELDEMPVPDSESVFIIPGSVLLWRIAPRPPNSAQMYNFTSFAMVLNEVDKDMESVIPKTDCRLRPDIRAMENGEIDQASEEKKRLEEKQRAARKNRSKSEEDWKTRWFHQGPNPYNGAQDWIYSGSYWDRNYFNLPDIY

SEQ ID NO: 1042 - protein, 292 aa, Homo sapiens
MSHLSQQKIYSGENPFACKVCGKVFSHKSNLTEHEHFHTREKPFECNECGKAFSQKQYVIKHQNTHTGEKLFECNECGKSFSQKENLLTHQKIHTGEKPFECKDCGKAFIQKSNLIRHQRTHTGEKPFVCKECGKTFSGKSNLTEHEKIHIGEKPFKCSECGTAFGQKKYLIKHQNIHTGEKPYECNECGKAFSQRTSLIVHVRIHSGDKPYECNVCGKAFSQSSSLTVHVRSHTGEKPYGCNECGKAFSQFSTLALHLRIHTGKKPYQCSECGKAFSQKSHHIRHQKIHTH

SEQ ID NO: 1043 - protein, 607 aa, Homo sapiens
MESCSVAQAGVQWPDLSSLQPPPPRFKQFSCHSLQVAGITDLDLQCEIISYIEVPTYETDISSTQLQSIYKREKLYECKKCQKKFSSGYQLILHHRFHVIERPYECKECGKNFRSGYQLTLHQRFHTGEKPYECTECGKNFRSGYQLTVHQRFHTGEKTYECRQCGKAFIYASHIVQHERIHTGGKPYECQECGRAFSQGGHLRIHQRVHTGEKPYKCKECGKTFSRRSNLVEHGQFHTDEKPYICEKCGKAFRRGHQLTVHQRVHTGKKPYECKECGKGYTTASYFLLHQRIHKGGKPYECKECKKTFTLYRNLTRHQNIHTGEKLFECKQCGKTYTTGSKLFQHQKTHTGEKPYECKECGKAFSLYGYLKQHQKIHTGMKHFECKECKKTFTLYRNLTRHQNIHTGKKLFECQECGKAYSTGSNLIQHRKTHTGEKPYKCKECGKTFSLHGYLNQHQKIHTGVKPYECKVCRKTFTFYRNLTLHQSIHTDEKPFECKECGKTFRRSSHLTAHQSIHADKKPYECKECGKAFKMYGYLTQHQKIHTGGKPYECKECGKAFSRASNLVQHERIHTGEKPYVCKQCGKTFRYGSALKAHQRIHRSIKV

SEQ ID NO: 1044 - protein, 353 aa, Homo sapiens
MATVIPSPLSLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDKFYKELAWVPEAQRKHTAKKAPDGTVIPNGYCDFCLGGSKKTGCPEDLISCADCGRSGHPSCLQFTVNMTAAVRTYRWQCIECKSCSLCGTSENDGASWAGLTPQDQLLFCDDCDRGYHMYCLSPPMAEPPEGSWSCHLCLRHLKEKASAYITLT

SEQ ID NO: 1045 - protein, 257 aa, Homo sapiens
MYEQLKGEWNRKSPNLSKCGEELGRLKLVLLELNFLPTTGTKLTKQQLILARDILEIGAQWSILRKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKRGWVLGPNNYYSFASQQQKPEDTTIPSTELAKQVIEYARQLEMIV

SEQ ID NO: 1046 - protein, 833 aa, Homo sapiens
MDVVDPDIFNRDPRDHYDLLQRLGGGTYGEVFKARDKVSGDLVALKMVKMEPDDDVSTLQKEILILKTCRHANIVAYHGSYLWLQKLWICMEFCGAGSLQDIYQVTGSLSELQISYVCREVLQGLAYLHSQKKIHRDIKGANILINDAGEVRLADFGISAQIGATLARRLSFIGTPYWMAPEVAAVALKGGYNELCDIWSLGITAIELAELQPPLFDVHPLRVLFLMTKSGYQPPRLKEKGKWSAAFHNFIKVTLTKSPKKRPSATKMLSHQLVSQPGLNRGLILDLLDKLKNPGKGPSIGDIEDEEPELPPAIPRRIRSTHRSSSLGIPDADCCRRHMEFRKLRGMETRPPANTARLQPPRDLRSSSPRKQLSESSDDDYDDVDIPTPAEDTPPPLPPKPKFRSPSDEGPGSMGDDGQLSPGVLVRCASGPPPNSPRPGPPPSTSSPHLTAHSEPSLWNPPSRELDKPPLLPPKKEKMKRKGCALLVKLFNGCPLRIHSTAAWTHPSTKDQHLLLGAEEGIFILNRNDQEATLEMLFPSRTTWVYSINNVLMSLSGKTPHLYSHSILGLLERKETRAGNPIAHISPHRLLARKNMVSTKIQDTKGCRACCVAEGASSGGPFLCGALETSVVLLQWYQPMNKFLLVRQVLFPLPTPLSVFALLTGPGSELPAVCIGVSPGRPGKSVLFHTVRFGALSCWLGEMSTEHRGPVQVTQVEEDMVMVLMDGSVKLVTPEGSPVRGLRTPEIPMTEAVEAVAMVGGQLQAFWKHGVQVWALGSDQLLQELRDPTLTFRLLGSPRLECSGTISPHCNLLLPGSSNSPASASRVAGITGL

SEQ ID NO: 1047 - protein, 218 aa, Homo sapiens
MAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFWQALDENMDLLEGITGFEDSVRKFICHVVGITYQHIDRWLLAEMLGDLSDSQLKVWMSKYGWSADESGQIFICSQEESIKPKNIVEKIDFDSVSSIMASSQ

SEQ ID NO: 1048 - protein, 218 aa, Homo sapiens; identical to SEQ ID NO: 1047

SEQ ID NO: 1049 - protein, 558 aa, Homo sapiens
MVKMAAAGGGGGGGRYYGGGSEGGRAPKRLKTDNAGDQHGGGGGGGGGAGAAGGGGGGENYDDPHKTPASPVVHIRGLIDGVVEADLVEALQEFGPISYVVVMPKKRQALVEFEDVLGACNAVNYAADNQIYIAGHPAFVNYSTSQKISRPGDSDDSRSVNSVLLFTILNPIYSITTDVLYTICNPCGPVQRIVIFRKNGVQAMVEFDSVQSAQRAKASLNGADIYSGCCTLKIEYAKPTRLNVFKNDQDTWDYTNPNLSGQGDPGSNPNKRQRQPPLLGDHPAEYGGPHGGYHSHYHDEGYGPPPPHYEGRRMGPPVGGHRRGPSRYGPQYGHPPPPPPPPEYGPHADSPVLMVYGLDQSKMNGDRVFNVFCLYGNVEKVKFMKSKPGAAMVEMADGYAVDRAITHLNNNFMFGQKLNVCVSKQPAIMPGQSYGLEDGSCSYKDFSESRNNRFSTPEQAAKNRIQHPSNVLHFFNAPLEVTEENFFEICDELGVKRPSSVKVFSGKSERSSSGLLEWESKSDALETLGFLNHYQMKNPNGPYPYTLKLCFSTAQHAS

SEQ ID NO: 1050 - protein, 389 aa, Homo sapiens
MAEPDPSHPLETQAGKVQEAQDSDSDSEGGAAGGEADMDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLISKAPLSTPRLLINKEKAGQSDPFLGMIMGLGGGMDFDSKKAYRDVAWLGECDQGCLALAELLGWKKELEDLVRREHASIDAQSGAGVPNPSTSASPKKSPPPAKDEARTTEREKPQ

SEQ ID NO: 1051 - protein, 352 aa, Homo sapiens
MDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLISKAPLSTPRLLINKEKAGQSDPFLGMIMGLGGGMDFDSKKAYRDVAWLGECDQGCLALAELLGWKKELEDLVRREHASIDAQSGAGVPNPSTSASPKKSPPPAKDEARTTEREKPQ

SEQ ID NO: 1052 - protein, 356 aa, Homo sapiens
MAGVACLGKAADADEWCDSGLGSLGPDAAAPGGPGLGAELGPGLSWAPLVFGYVTEDGDTALHLAVIHQHEPFLDFLLGFSAGTEYMDLQNDLGQTALHLAAILGETSTVEKLYAAGAGLCVAERRGHTALHLACRVGAHACARALLQPRPRRPREAPDTYLAQGPDRTPDTNHTPVALYPDSDLEKEEEESEEDWKLQLEAENYEGHTPLHVAVIHKDVEMVRLLRDAGADLDKPEPTCGRSPLHLAVEAQAADVLELLLRAGANPAARMYGGRTPLGSAMLRPNPILARLLRAHGAPEPEGEDEKSGPCSSSSDSDSGDEGDEYDDIVVHSSRSQTRLPPTPASKPLPDDPRPV

SEQ ID NO: 1053 - protein, 518 aa, Homo sapiens
MAASMARRLWPLLTRRGFRPRGGCISNDSPRRSFTTEKRNRNLLYEYAREGYSALPQLDIERFCACPEEAAHALELRKGELRSADLPAIISTWQELRQLQEQIRSLEEEKAAVTEAVRALLANQDSGEVQQDPKYQGLRARGREIRKELVHLYPREAQLEEQFYLQALKLPNQTHPDVPVGDESQARVLHMVGDKPVFSFQPRGHLEIGEKLDIIRQKRLSHVSGHRSYYLRGAGALLQHGLVNFTFNKLLRRGFTPMTVPDLLRGAVFEGCGMTPNANPSQIYNIDPARFKDLNLAGTAEVGLAGYFMDHTVAFRDLPVRMVCSSTCYRAETNTGQEPRGLYRVHHFTKVEMFGVTGPGLEQSSQLLEEFLSLQMEILTELGLHFRVLDMPTQELGLPAYRKFDIEAWMPGRGRFGEVTSASNCTDFQSRRLHIMFQTEAGELQFAHTVNATACAVPRLLIALLESNQQKDGSVLVPPALQSYLGTDRITAPTHVPLQYIGPNQPRKPGLPGQPAVS

SEQ ID NO: 1054 - protein, 138 aa, Homo sapiens
MSWSGLLHGLNTSLTCGPALVPRLWATCSMATLNQMHRLGPPKRPPRKLGPTEGRPQLKGVVLCTFTRKPKKPNSANRKCCRVRLSTGREAVCFIPGEGHTLQEHQIVLVEGGRTQDLPGVKLTVVRGKYDCGHVQKK

SEQ ID NO: 1055 - protein, 138 aa, Homo sapiens; identical to SEQ ID NO: 1054

SEQ ID NO: 1056 - protein, 138 aa, Homo sapiens; identical to SEQ ID NO: 1054

SEQ ID NO: 1057 - protein, 278 aa, Homo sapiens
MGARLSRRRLPADPSLALDALPPELLVQVLSHVPPRSLVTRCRPVCRAWRDIVDGPTVWLLQLARDRSAEGRALYAVAQRCLPSNEDKEEFPLCALARYCLRAPFGRNLIFNSCGEQGFRGWEVEHGGNGWAIEKNLTPVPGAPSQTCFVTSFEWCSKRQLVDLVMEGVWQELLDSAQIEICVADWWGARENCGCVYQLRVRLLDVYEKEVVKFSASPDPVLQWTERGCRQVSHVFTNFGKGIRYVSFEQYGRDVSSWVGHYGALVTHSSVRVRIRLS

SEQ ID NO: 1058 - protein, 287 aa, Homo sapiens
MKQGLWLLEMGARLSRRRLPADPSLALDALPPELLVQVLSHVPPRSLVTRCRPVCRAWRDIVDGPTVWLLQLARDRSAEGRALYAVAQRCLPSNEDKEEFPLCALARYCLRAPFGRNLIFNSCGEQGFRGWEVEHGGNGWAIEKNLTPVPGAPSQTCFVTSFEWCSKRQLVDLVMEGVWQELLDSAQIEICVADWWGARENCGCVYQLRVRLLDVYEKEVVKFSASPDPVLQWTERGCRQVSHVFTNFGKGIRYVSFEQYGRDVSSWVGHYGALVTHSSVRVRIRLS

SEQ ID NO: 1059 - protein, 591 aa, Homo sapiens
MFGKRKKRVEISAPSNFEHRVHTGFDQHEQKFTGLPRQWQSLIEESARRPKPLVDPACITSIQPGAPKTIVRGSKGAKDGALTLLLDEFENMSVTRSNSLRRDSPPPPARARQENGMPEEPATTARGGPGKAGSRGRFAGHSEAGGGSGDRRRAGPEKRPKSSREGSGGPQESSRDKRPLSGPDVGTPQPAGLASGAKLAAGRPFNTYPRADTDHPSRGAQGEPHDVAPNGPSAGGLAIPQSSSSSSRPPTRARGAPSPGVLGPHASEPQLAPPACTPAAPAVPGPPGPRSPQREPQRVSHEQFRAALQLVVDPGDPRSYLDNFIKIGEGSTGIVCIATVRSSGKLVAVKKMDLRKQQRRELLFNEVVIMRDYQHENVVEMYNSYLVGDELWVVMEFLEGGALTDIVTHTRMNEEQIAAVCLAVLQALSVLHAQGVIHRDIKSDSILLTHDGRVKLSDFGFCAQVSKEVPRRKSLVGTPYWMAPELISRLPYGPEVDIWSLGIMVIEMVDGEPPYFNEPPLKAMKMIRDNLPPRLKNLHKVSPSLKGFLDRLLVRDPAQRATAAELLKHPFLAKAGPPASIVPLMRQNRTR

SEQ ID NO: 1060 - protein, 591 aa, Homo sapiens; identical to SEQ ID NO: 1059

SEQ ID NO: 1061 - protein, 531 aa, Homo sapiens
MAPTIQTQAQREDGHRPNSHRTLPERSGVVCRVKYCNSLPDIPFDPKFITYPFDQNRFVQYKATSLEKQHKHDLLTEPDLGVTIDLINPDTYRIDPNVLLDPADEKLLEEEIQAPTSSKRSQQHAKVVPWMRKTEYISTEFNRYGISNEKPEVKIGVSVKQQFTEEEIYKDRDSQITAIEKTFEDAQKSISQHYSKPRVTPVEVMPVFPDFKMWINPCAQVIFDSDPAPKDTSGAAALEMMSQAMIRGMMDEEGNQFVAYFLPVEETLKKRKRDQEEEMDYAPDDVYDYKIAREYNWNVKNKASKGYEENYFFIFREGDGVYYNELETRVRLSKRRAKAGVQSGTNALLVVKHRDMNEKELEAQEARKAQLENHEPEEEEEEEMETEEKEAGGSDEEQEKGSSSEKEGSEDEHSGSESEREEGDRDEASDKSGSGEDESSEDEARAARDKEEIFGSDADSEDDADSDDEDRGQAQGGSDNDSDSGSNGGGQRSRSHSRSASPFPSGSEHSAQEDGSEAAASDSSEADSDSD

SEQ ID NO: 1062 - protein, 351 aa, Homo sapiens
MWMKDPVARPLSPTRLQPALPPEAQSVPELEEVARVLAEIPRPLKRRGSMEQAPAVALPPTHKKQYQQIISRLFHRHGGPGPGGRSQSCPPSLRDLRPGQGPLLLPHQLPFHRPAPSQSSPPEQPQSMEMRSVLRKAGSPRKARRARLNPLVLLLDAALTGELEVVQQAVKEMNDPSQPNEEGITALHNAICGANYSIVDFLITAGANVNSPDSHGWTPLHCAASCNDTVICMALVQHGAAIFATTLSDGATAFEKCDPYREGYADCATYLADVEQSMGLMNSGAVYALWDYSAEFGDELSFREGESVTVLRRDGPEETDWWWAALHGQEGYVPRNYFGLFPRVKPQRSKV

SEQ ID NO: 1063 - protein, 510 aa, Homo sapiens
MEEPQAGDAARFSCPPNFTAKPPASESPRFSLEALTGPDTELWLIQAPADFAPECFNGRHVPLSGSQIVKGKLAGKRHRYRVLSSCPQAGEATLLAPSTEAGGGLTCASAPQGTLRILEGPQQSLSGSPLQPIPASPPPQIPPGLRPRFCAFGGNPPVTGPRSALAPNLLTSGKKKKEMQVTEAPVTQEAVNGHGALEVDMALGSPEMDVRKKKKKKNQQLKEPEAAGPVGTEPTVETLEPLGVLFPSTTKKRKKPKGKETFEPEDKTVKQEQINTEPLEDTVLSPTKKRKRQKGTEGMEPEEGVTVESQPQVKVEPLEEAIPLPPTKKRKKEKGQMAMMEPGTEAMEPVEPEMKPLESPGGTMAPQQPEGAKPQAQAALAAPKKKTKKEKQQDATVEPETEVVGPELPDDLEPQAAPTSTKKKKKKKERGHTVTEPIQPLEPELPGEGQPEARATPGSTKKRKKQSQESRMPETVPQEEMPGPPLNSESGEEAPTGRDKKRKQQQQQPV

SEQ ID NO: 1064 - protein, 179 aa, Homo sapiens
MVVGAFPMAKLLYLGIRQVSKPLANRIKEAARRSEFFKTYICLPPAQLYHWVEMRTKMRIMGFRGTVIKPLNEEAAAELGAELLGEATIFIVGGGCLVLEYWRHQAQQRHKEEEQRAAWNALRDEVGHLALALEALQAQVQAAPPQGALEELRTELQEVRAQLCNPGRSASHAVPASKK

SEQ ID NO: 1065 - protein, 649 aa, Homo sapiens
MSSFGAGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 1066 - protein, 466 aa, Homo sapiens
MTTSPILQLLLRLSLCGLLLQRAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVQSEIRRGWHHCRLRRSLGEEQRQLPERAFRALPSGSGPGEVPTSRGLSSGTLPGPGNEASRELESYC

SEQ ID NO: 1067 - protein, 118 aa, Homo sapiens
MSLLNKPKSEMTPEELQKREEEEFNTGPLSVLTQSVKNNTQVLINCRNNKKLLGRVKAFDRHCNMVLENVKEMWTEVPKSGKGKKKSKPVNKDRYISKMFLRGDSVIVVLRNPLIAGK

SEQ ID NO: 1068 - protein, 118 aa, Homo sapiens; identical to SEQ ID NO: 1067

SEQ ID NO: 1069 - protein, 629 aa, Homo sapiens
MSAEVRLRRLQQLVLDPGFLGLEPLLDLLLGVHQELGASELAQDKYVADFLQWAEPIVVRLKEVRLQRDDFEILKVIGRGAFSEVAVVKMKQTGQVYAMKIMNKWDMLKRGEVSCFREERDVLVNGDRRWITQLHFAFQDENYLYLVMEYYVGGDLLTLLSKFGERIPAEMARFYLAEIVMAIDSVHRLGYVHRDIKPDNILLDRCGHIRLADFGSCLKLRADGTVRSLVAVGTPDYLSPEILQAVGGGPGTGSYGPECDWWALGVFAYEMFYGQTPFYADSTAETYGKIVHYKEHLSLPLVDEGVPEEARDFIQRLLCPPETRLGRGGAGDFRTHPFFFGLDWDGLRDSVPPFTPDFEGATDTCNFDLVEDGLTAMVSGGGETLSDIREGAPLGVHLPFVGYSYSCMALRDSEVPGPTPMELEAEQLLEPHVQAPSLEPSVSPQDETAEVAVPAAVPAAEAEAEVTLRELQEALEEEVLTRQSLSREMEAIRTDNQNFASQLREAEARNRDLEAHVRQLQERMELLQAEGATAVTGVPSPRATDPPSHLDGPPAVAVGQCPLVGPGPMHRRHLLLPARVPRPGLSEALSLLLFAVVLSRAAALGCIGLVAHAGQLTAVWRRPGAARAP

SEQ ID NO: 1070 - protein, 499 aa, Homo sapiens
MAMAEGERTECAEPPRDEPPADGALKRAEELKTQANDYFKAKDYENAIKFYSQAIELNPSNAIYYGNRSLAYLRTECYGYALGDATRAIELDKKYIKGYYRRAASNMALGKFRAALRDYETVVKVKPHDKDAKMKYQECNKIVKQKAFERAIAGDEHKRSVVDSLDIESMTIEDEYSGPKLEDGKVTISFMKELMQWYKDQKKLHRKCAYQILVQVKEVLSKLSTLVETTLKETEKITVCGDTHGQFYDLLNIFELNGLPSETNPYIFNGDFVDRGSFSVEVILTLFGFKLLYPDHFHLLRGNHETDNMNQIYGFEGEVKAKYTAQMYELFSEVFEWLPLAQCINGKVLIMHGGLFSEDGVTLDDIRKIERNRQPPDSGPMCDLLWSDPQPQNGRSISKRGVSCQFGPDVTKAFLEENNLDYIIRSHEVKAEGYEVAHGGRCVTVFSAPNYCDQMGNKASYIHLQGSDLRPQFHQFTAVPHPNVKPMAYANTLLQLGMM

SEQ ID NO: 1071 - protein, 878 aa, Homo sapiens
MATAPSYPAGLPGSPGPGSPPPPGGLELQSPPPLLPQIPAPGSGVSFHIQIGLTREFVLLPAASELAHVKQLACSIVDQKFPECGFYGLYDKILLFKHDPTSANLLQLVRSSGDIQEGDLVEVVLSASATFEDFQIRPHALTVHSYRAPAFCDHCGEMLFGLVRQGLKCDGCGLNYHKRCAFSIPNNCSGARKRRLSSTSLASGHSVRLGTSESLPCTAEELSRSTTELLPRRPPSSSSSSSASSYTGRPIELDKMLLSKVKVPHTFLIHSYTRPTVCQACKKLLKGLFRQGLQCKDCKFNCHKRCATRVPNDCLGEALINGDVPMEEATDFSEADKSALMDESEDSGVIPGSHSENALHASEEEEGEGGKAQSSLGYIPLMRVVQSVRHTTRKSSTTLREGWVVHYSNKDTLRKRHYWRLDCKCITLFQNNTTNRYYKEIPLSEILTVESAQNFSLVPPGTNPHCFEIVTANATYFVGEMPGGTPGGPSGQGAEAARGWETAIRQALMPVILQDAPSAPGHAPHRQASLSISVSNSQIQENVDIATVYQIFPDEVLGSGQFGVVYGGKHRKTGRDVAVKVIDKLRFPTKQESQLRNEVAILQSLRHPGIVNLECMFETPEKVFVVMEKLHGDMLEMILSSEKGRLPERLTKFLITQILVALRHLHFKNIVHCDLKPENVLLASADPFPQVKLCDFGFARIIGEKSFRRSVVGTPAYLAPEVLLNQGYNRSLDMWSVGVIMYVSLSGTFPFNEDEDINDQIQNAAFMYPASPWSHISAGAIDLINNLLQVKMRKRYSVDKSLSHPWLQEYQTWLDLRELEGKMGERYITHESDDARWEQFAAEHPLPGSGLPTDRDLGGACPPQDHDMQGLAERISVL

SEQ ID NO: 1072 - protein, 878 aa, Homo sapiens; identical to SEQ ID NO: 1071

SEQ ID NO: 1073 - protein, 753 aa, Homo sapiens
MMEERAAAAVAAAASSCRPLGSGAGPGPTGAAPVSAPAPGPGPAGKGGGGGGSPGPTAGPEPLSLPGILHFIQHEWARFEAEKARWEAERAELQAQVAFLQGERKGQENLKTDLVRRIKMLEYALKQERAKYHKLKFGTDLNQGEKKADVSEQVSNGPVESVTLENSPLVWKEGRQLLRQYLEEVGYTDTILDMRSKRVRSLLGRSLELNGAVEPSEGAPRAPPGPAGLSGGESLLVKQIEEQIKRNAAGKDGKERLGGSVLGQIPFLQNCEDEDSDEDDELDSVQHKKQRVKLPSKALVPEMEDEDEEDDSEDAINEFDFLGSGEDGEGAPDPRRCTVDGSPHELESRRVKLQGVLADLRDVDGLPPKVTGPPPGTPQPRPHEDVFIMDTIGGGEVSLGDLADLTVTNDNDLSCDLSDSKDAFKKTWNPKFTLRSHYDGIRSLAFHHSQSALLTASEDGTLKLWNLQKAVTAKKNAALDVEPIHAFRAHRGPVLAVAMGSNSEYCYSGGADACIHSWKIPDLSMDPYDGYDPSVLSHVLEGHGDAVWGLAFSPTSQRLASCSADGTVRIWDPSSSSPACLCTFPTASEHGVPTSVAFTSTEPAHIVASFRSGDTVLYDMEVGSALLTLESRGSSGPTQINQVVSHPNQPLTITAHDDRGIRFLDNRTGKPVHSMVAHLDAVTCLAVDPNGAFLMSGSHDCSLRLWSLDNKTCVQEITAHRKKHEEAIHAVACHPSKALIASAGADALAKVFV

SEQ ID NO: 1074 - protein, 541 aa, Homo sapiens
MVADPPRDSKGLAAAEPTANGGLALASIEDQGAAAGGYCGSRDQVRRCLRANLLVLLTVVAVVAGVALGLGVSGAGGALALGPERLSAFVFPGELLLRLLRMIILPLVVCSLIGGAASLDPGALGRLGAWALLFFLVTTLLASALGVGLALALQPGAASAAINASVGAAGSAENAPSKEVLDSFLDLARNIFPSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 1075 - protein, 142 aa, Homo sapiens
MIRFILIQNRAGKTRLAKWYMQFDDDEKQKLIEEVHAVVTVRDAKHTNFVEFRNFKIIYRRYAGLYFCICVDVNDNKLAYLEGIHNFVEVLNEYFHNVCELDLVFNFYKVYTVVDEMFLAGEIRETSQTKVLKQLLMLQSLE

SEQ ID NO: 1076 - protein, 104 aa, Homo sapiens
MIRFILIQNRAGKTRLAKWYMQFDDDEKQKLIEEVHAVVTVRDAKHTNFVEVLNEYFHNVCELDLVFNFYKVYTVVDEMFLAGEIRETSQTKVLKQLLMLQSLE

SEQ ID NO: 1077 - protein, 142 aa, Homo sapiens; identical to SEQ ID NO: 1075

SEQ ID NO: 1078 - protein, 104 aa, Homo sapiens; identical to SEQ ID NO: 1076

SEQ ID NO: 1079 - protein, 1514 aa, Homo sapiens
MMMARKQDVRIPTYNISVVGLSGTEKEKGQCGIGKSCLCNRFVRPSADEFHLDHTSVLSTSDFGGRVVNNDHFLYWGEVSRSLEDCVECKMHIVEQTEFIDDQTFQPHRSTALQPYIKRAAATKLASAEKLMYFCTDQLGLEQDFEQKQMPDGKLLVDGFLLGIDVSRGMNRNFDDQLKFVSNLYNQLAKTKKPIVVVLTKCDEGVERYIRDAHTFALSKKNLQVVETSARSNVNVDLAFSTLVQLIDKSPGKTKIIPYFEALKQQSQQIATAKDKYEWLVSRIVKNHNENWLSVSRKMQASPEYQDYDYLEGTQKAKKLFLQHIHRLKHEHIERRRKLYLAALPLAFEALIPNLDEIDHLGCIKAKKLLETKPEFLKWFVVLEETPWDATSHIDNMENERIPFDLMDTVPAEALYEAHLEKLRNERKRVEMRRAFKENLETSPFITPGKPWEEARSFIMNEDFYQWLEESVYTDIYGKHQKQIIDKAKEEFQELLLEYSELFYELELDAKPSKEKMGVIQDVLGEEQRFKAIYKSSKQSVDALILKHIHFVYHPTKETCPSCPACVDAKIEHLISSRFIRPSDRNQKNSLSDPNIDRINLVILGKDALPESWPMEIRALCTNDDKYVIDGKMYELSLRPIEGNVRLPVNSFQTPTFQPHGCLCLYNSKESLSYVVESIEKSRESTLGRRDNHLVHLPLTLILVNKRGDTSGETLHSLIQQGQQIASKLQCVFLDPASAGIGYGRNINEKQISQVLKGLLDSKRNLNLVSSTASIKDLADVDLRIVMCLMCGDPFSADDILFPVLQSQTCKSSHCGSNNSVLLELPIGLHKKRIELSVLSYHSSFSIRKSRLVHGYIVFYSAKRKASLAMLRAFLCEVQDIIPIQLVALTDGAVDVLDNDLSREQLTEGEEIAQEIDGRFTSIPCSQPQHKLEIFHPFFKDVVEKKNIIEATHMYDNAAEACSTTEEVFNSPRAGSPLSNSNLQDSEEDIEPSYSLFREDTSLPSLSKDHSKLSMELEGNDGLSFIMSNFESKLNNKVPPPVKPKPPVHFEITKGDLSYLDQGHRDGQRKSVSSSPWLPQDGFDPSDYAEPMDAVVKPRNEEENIYSVPHDSTQGKIITIRNINKAQSNGSGNGSDSEMDTSSLERGRKVSIVSKPVLYRTRCTRLGRFASYRTSFSVGSDDELGPIRKKEEDQASQGYKGDNAVIPYETDEDPRRRNILRSLRRNTKKPKPKPRPSITKATWESNYFGVPLTTVVTPEKPIPIFIERCIEYIEATGLSTEGIYRVSGNKSEIESLQRQFDQDHNLDLAEKDFTVNTVAGAMKSFFSELPDPLVPYNMQIDLVEAHKINDREQKLHALKEVLKKFPKENHEVFKYVISHLNKVSHNNKVNLMTSENLSICFWPTLMRPDFSTMDALTATRTYQTIIELFIQQCPFFFYNRPITEPPGARPSSPSAVASTVPFLTSTPVTSQPSPPQSPPPTPQSPMQPLLPSPLHPHRPTPQPSRNIPWQTKEH

SEQ ID NO: 1080 - protein, 1499 aa, Homo sapiens
MMMARKQDVRIPTYNISVVGLSGTEKEKGQCGIGKSCLCNRFVRPSADEFHLDHTSVLSTSDFGGRVVNNDHFLYWGEVSRSLEDCVECKMHIVEQTEFIDDQTFQPHRSTALQPYIKRAAATKLASAEKLMYFCTDQLGLEQDFEQKQMPDGKLLVDGFLLGIDVSRGMNRNFDDQLKFVSNLYNQLAKTKKPIVVVLTKCDEGVERYIRDAHTFALSKKNLQVVETSARSNVNVDLAFSTLVQLIDKSRGKTKIIPYFEALKQQSQQIATAKDKYEWLVSRIVKNHNENWLSVSRKMQASPEYQDYVYLEGTQKAKKLFLQHIHRLKHEHIERRRKLYLAALPLAFEALIPNLDEIDHLSCIKAKKLLETKPEFLKWFVVLEETPWDATSHIDNMENERIPFDLMDTVPAEQLYEAHLEKLRNERKRVEMRRAFKENLETSPFITPGKPWEEARSFIMNEDFYQWLEESVYMDIYGKHQKQIIDKAKEEFQELLLEYSELFYELELDAKPSKEKMGVIQDVLGEEQRFKALQKLQAERDALILKHIHFVYHPTKETCPSCPACVDAKIEHLISSRFIRPSDRNQKNSLSDPNIDRINLVILGKDGLARELANEIRALCTNDDKYVIDGKMYELSLRPIEGNVRLPVNSFQTPTFQPHGCLCLYNSKESLSYVVESIEKSRESTLGRRDNHLVHLPLTLILVNKRGDTSGETLHSLIQQGQQIASKLQCVFLDPASAGIGYGRNINEKQISQVLKGLLDSKRNLNLVSSTASIKDLADVDLRIVMCLMCGDPFSADDILFPVLQSQTCKSSHCGSNNSVLLELPIGLHKKRIELSVLSYHSSFSIRKSRLVHGYIVFYSAKRKASLAMLRAFLCEVQDIIPIQLVALTDGAVDVLDNDLSREQLTEGEEIAQEIDGRFTSIPCSQPQHKLEIFHPFFKDVVEKKNIIEATHMYDNAAEACSTTEEVFNSPRAGSPLCNSNLQDSEEDIEPSYSLFREDTSLPSLSKDHSKLSMELEGNDGLSFIMSNFESKLNNKVPPPVKPKPPVHFEITKGDLSYLDQGHRDGQRKSVSSSPWLPQDGFDPSDYAEPMDAVVKPRNEEENIYSVPHDSTQGKIITIRNINKAQSNGSGNGSDSEMDTSSLERGRKVSIVSKPVLYRTRCTRLGRFASYRTSFSVGSDDELGPIRKKEEDQASQGYKGDNAVIPYETDEDPRRRNILRSLRRNTKKPKPKPRPSITKATWESNYFGVPLTTVVTPEKPIPIFIERCIEYIEATGLSTEGIYRVSGNKSEMESLQRQFDQDHNLDLAEKDFTVNTVAGAMKSFFSELPDPLVPYNMQIDLVEAHKINDREQKLHALKEVLKKFPKENHEVFKYVISHLNKVSHNNKVNLMTSENLSICFWPTLMRPDFSTMDALTATRTYQTIIELFIQQCPFFFYNRPITEPPGARPSSPSAVASTVPFLTSTPVTSQPSPPQSPPPTPQSPMQPLLPSQLQAEHTL

SEQ ID NO: 1081 - protein, 350 aa, Homo sapiens
MNSFNYTTPDYGHYDDKDTLDLNTPVDKTSNTLRVPDILALVIFAVVFLVGVLGNALVVWVTAFEAKRTINAIWFLNLAVADFLSCLALPILFTSIVQHHHWPFGGAACSILPSLILLNMYASILLLATISADRFLLVFKPIWCQNFRGAGLAWIACAVAWGLALLLTIPSFLYRVVREEYFPPKVLCGVDYSHDKRRERAVAIVRLVLGFLWPLLTLTICYTFILLRTWSRRATRSTKTLKVVVAVVASFFIFWLPYQVTGIMMSFLEPSSPTFLLLNKLDSLCVSFAYINCCINPIIYVVAGQGFQGRLRKSLPSLLRNVLTEESVVRESKSFTRSTVDTMAQKTQAV

SEQ ID NO: 1082 - protein, 295 aa, Homo sapiens
MDNSGKEAEAMALLAEAERKVKNSQSFFSGLFGGSSKIEEACEIYARAANMFKMAKNWSAAGNAFCQAAQLHLQLQSKHDAATCFVDAGNAFKKADPQEAINCLMRAIEIYTDMGRFTIAAKHHISIAEIYETELVDIEKAIAHYEQSADYYKGEESNSSANKCLLKVAGYAALLEQYQKAIDIYEQVGTNAMDTPLLKYSAKDYFFKAALCHFCIDMLNAKLAVQKYEELFPAFSDSRECKLMKKLLEAHEEQNVDSYTESVKEYDSISRLDQWLTTMLLRIKKTIQGDEEDLR

SEQ ID NO: 1083 - protein, 543 aa, Homo sapiens
MFSWLKRGGARGQQPEAIRTVTSALKELYRTKLLPLEEHYRFGAFHSPALEDADFDGKPMVLVAGQYSTGKTSFIQYLLEQEVPGSRVGPEPTTDCFVAVMHGDTEGTVPGNALVVDPDKPFRKLNPFGNTFLNRFMCAQLPNQVLESISIIDTPGILSGAKQRVSRGYDFPAVLRWFAERVDLIILLFDAHKLEISDEFSEAIGALRGHEDKIRVVLNKADMVETQQLMRVYGALMWALGKVVGTPEVLRVYIGSFWSQPLLVPDNRRLFELEEQDLFRDIQGLPRHAALRKLNDLVKRARLVRVHAYIISYLKKEMPSVFGKENKKKQLILKLPVIFAKIQLEHHISPGDFPDCQKMQELLMAHDFTKFHSLKPKLLEALDEMLTHDIAKLMPLLRQEELESTEVGVQGGAFEGTHMGPFVERGPDEAMEDGEEGSDDEAEWVVTKDKSKYDEIFYNLAPADGKLSGSKAKTWMVGTKLPNSVLGRIWKLSDVDRDGMLDDEEFALASHLIEAKLEGHGLPANLPRRLVPPSKRRHKGSAE

SEQ ID NO: 1084 - protein, 543 aa, Homo sapiens; identical to SEQ ID NO: 1083

SEQ ID NO: 1085 - protein, 543 aa, Homo sapiens; identical to SEQ ID NO: 1083

SEQ ID NO: 1086 - protein, 919 aa, Homo sapiens
MQRSIMSFFHPKKEGKAKKPEKEASNSSRETEPPPKAALKEWNGVVSESDSPVKRPGRKAARVLGSEGEEEDEALSPAKGQKPALDCSQVSPPRPATSPENNASLSDTSPMDSSPSGIPKRRTARKQLPKRTIQEVLEEQSEDEDREAKRKKEEEEEETPKESLTEAEVATEKEGEDGDQPTTPPKPLKTSKAETPTESVSEPEVATKQELQEEEEQTKPPRRAPKTLSSFFTPRKPAVKKEVKEEEPGAPGKEGAAEGPLDPSGYNPAKNNYHPVEDACWKPGQKVPYLAVARTFEKIEEVSARLRMVETLSNLLRSVVALSPPDLLPVLYLSLNHLGPPQQGLELGVGDGVLLKAVAQATGRQLESVRAEAAEKGDVGLVAENSRSTQRLMLPPPPLTASGVFSKFRDIARLTGSASTAKKIDIIKGLFVACRHSEARFIARSLSGRLRLGLAEQSVLAALSQAVSLTPPGQEFPPAMVDAGKGKTAEARKTWLEEQGMILKQTFCEVPDLDRIIPVLLEHGLERLPEHCKLSPGIPLKPMLAHPTRGISEVLKRFEEAAFTCEYKYDGQRAQIHALEGGEVKIFSRNQEDNTGKYPDIISRIPKIKLPSVTSFILDTEAVAWDREKKQIQPFQVLTTRKRKEVDASEIQVQVCLYAFDLIYLNGESLVREPLSRRRQLLRENFVETEGEFVFATSLDTKDIEQIAEFLEQSVKDSCEGLMVKTLDVDATYEIAKRSHNWLKLKKDYLDGVGDTLDLVVIGAYLGRGKRAGRYGGFLLASYDEDSEELQAICKLGTGFSDEELEEHHQSLKALVLPSPRPYVRIDGAVIPDHWLDPSAVWEVKCADLSLSPIYPAARGLVDSDKGISLRFPRFIRVREDKQPEQATTSAQVACLYRKQSQIQNQQGEDSGSDPEDTY

SEQ ID NO: 1087 - protein, 212 aa, Homo sapiens
MNLFRFLGDLSHLLAIILLLLKIWKSRSCAGISGKSQVLFAVVFTARYLDLFTNYISLYNTCMKVVYIACSFTTVWLIYSKFKATYDGNHDTFRVEFLVVPTAILAFLVNHDFTPLEILWTFSIYLESVAILPQLFMVSKTGEAETITSHYLFALGVYRTLYLFNWIWRYHFEGFFDLIAIVAGLVQTVLYCDFFYLYITKVLKGKKLSLPA

SEQ ID NO: 1088 - protein, 446 aa, Homo sapiens
MAARKGRRRTCETGEPMEAESGDTSSEGPAQVYLPGRGPPLREGEELVMDEEAYVLYHRAQTGAPCLSFDIVRDHLGDNRTELPLTLYLCAGTQAESAQSNRLMMLLMHNLHGTKPPPSEGSDEEEEEEDEEDEEERKPQLELAMVPHYGGINRVRVSWLGEEPVAGVWSEKGQVEVFALRRLLQVVEEPQALAAFLRDEQAQMKPIFSFAGHMGEGFALDWSPRVTGRLLTGDCQKNIHLWTPADGGSWHVDQRPFVGHTRSVEDLQWSPTENTVFASCSADASIRIWDIRAAPSKACMLTTATAHDGDVNVISWSRREPFLLSGGDDGALKIWDLRQFKSGSPVATFKQHVAPVTSVEWHPQDSGVFAASGADHQITQWDLAVERDPEAGDVEADPGLADLPQQLLFVHQGETELKELHWHPQCPGLLVSTALSGFTIFRTISV

SEQ ID NO: 1089 - protein, 188 aa, Homo sapiens [sequence omitted]

SEQ ID NO: 1090 - protein, 325 aa, Homo sapiens
MARPVSDRTPAPLLLGGPAGTPPGGGALLGLRSLLQGTSKPKEPASCLLKEKERKAALPAATTPGPGLETAGPADAPAGAVVGGGSPRGRPGPVPAPGLLAPLLWERTLPFGDVEYVDLDAFLLEHGLPPSPPPPGGPSPEPSPARTPAPSPGPGSCGSASPRSSPGHAPARAALGTASGHRAGLTSRDTPSPVDPDTVEVLMTFEPDPADLALSSIPGHETFDPRRHRFSEEELKPQPIMKKARKIQVPEEQKDEKYWSRRYKNNEAAKRSRDARRLKENQISVRAAFLEKENALLRQEVVAVRQELSHYRAVLSRYQAQHGAL

SEQ ID NO: 1091 - protein, 365 aa, Homo sapiens
MWLRSHRQLCLAFLLVCVLSVIFFLHIHQDSFPHGLGLSILCPDRRLVTPPVAIFCLPGTAMGPNASSSCPQHPASLSGTWTVYPNGRFGNQMGQYATLLALAQLNGRRAFILPAMHAALAPVFRITLPVLAPEVDSRTPWRELQLHDWMSEEYADLRDPFLKLSGFPCSWTFFHHLREQIRREFTLHDHLREEAQSVLGQLRLGRTGDRPRTFVGVHVRRGDYLQVMPQRWKGVVGDSAYLRQAMDWFRARHEAPVFVVTSNGMEWCKENIDTSQGDVTFAGDGQEATPWKDFALLTQCNHTIMTIGTFGFWAAYLAGGDTVYLANFTLPDSEFLKIFKPEAAFLPEWVGINADLSPLWTLAKP

SEQ ID NO: 1092 - protein, 365 aa, Homo sapiens; identical to SEQ ID NO: 1091

SEQ ID NO: 1093 - protein, 779 aa, Homo sapiens
MEGSRPRSSLSLASSASTISSLSSLSPKKPTRAVNKIHAFGKRGNALRRDPNLPVHIRGWLHKQDSSGLRLWKRRWFVLSGHCLFYYKDSREESVLGSVLLPSYNIRPDGPGAPRGRRFTFTAEHPGMRTYVLAADTLEDLRGWLRALGRASRAEGDDYGQPRSPARPQPGEGPGGPGGPPEVSRGEEGRISESPEVTRLSRGRGRPRLLTPSPTTDLHSGLQMRRARSPDLFTPLSRPPSPLSLPRPRSAPARRPPAPSGDTAPPARPHTPLSRIDVRPPLDWGPQRQTLSRPPTPRRGPPSEAGGGKPPRSPQHWSQEPRTQAHSGSPTYLQLPPRPPGTRASMVLLPGPPLESTFHQSLETDTLLTKLCGQDRLLRRLQEEIDQKQEEKEQLEAALELTRQQLGQATREAGAPGRAWGRQRLLQDRLVSVRATLCHLTQERERVWDTYSGLEQELGTLRETLEYLLHLGSPQDRVSAQQQLWMVEDTLAGLGGPQKPPPHTEPDSPSPVLQGEESSERESLPESLELSSPRSPETDWGRPPGGDKDLASPHLGLGSPRVSRASSPEGRHLPSPQLGTKAPVARPRMNAQEQLERMRRNQECGRPFPRPTSPRLLTLGRTLSPARRQPDVEQRPVVGHSGAQKWLRSSGSWSSPRNTTPYLPTSEGHRERVLSLSQALATEASQWHRMMTGGNLDSQGDPLPGVPLPPSDPTRQETPPPRSPPVANSGSTGFSRRGSGRGGGPTPWGPAWDAGIAPPVLPQDEGAWPLRVTLLQSSL

SEQ ID NO: 1094 - protein, 461 aa, Homo sapiens
MPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEVSRLRMLLKAKMDAEQDPNVQVDHLNLLKQFEHLDPQNQHTFEARDLELLIQTATRDLAQYDAAHHEEFKRYEMLKEHERRRYLESLGEEQRKEAERKLEEQQRRHREHPKVNVPGSQAQLKEVWEELDGLDPNRFNPKTFFILHDINSDGVLDEQELEALFTKELEKVYDPKNEEDDMREMEEERLRMREHVMKNVDTNQDRLVTLEEFLASTQRKEFGDTGEGWETVEMHPAYTEEELRRFEEELAAREAELNAKAQRLSQETEALGRSQGRLEAQKRELQQAVLHMEQRKQQQQQQQGHKAPAAHPEGQLKFHPDTDDVPVPAPAGDQKEVDTSEKKLLERLPEVEVPQHL

SEQ ID NO: 1095 - protein, 218 aa, Homo sapiens
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWVRLLKPPHPHHRALTTAPAPPSLPPATPLGPWAFWSRSQWCPLPIFRSSDVVYNAFSLRV

SEQ ID NO: 1096 - protein, 192 aa, Homo sapiens
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 1097 - protein, 41 aa, Homo sapiens
MDGSGEQPRGGVSSRIEQGEWGGRHPSWPWTRCLRMRPPRS

SEQ ID NO: 1098 - protein, 143 aa, Homo sapiens
MDGSGEQPRGGGPTSSEQIMKTGALLLQGMIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 1099 - protein, 164 aa, Homo sapiens
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKAGVKWRDLGSLQPLPPGFKRFTCLSIPRSWDYRPCAPRCRN

SEQ ID NO: 1100 - protein, 179 aa, Homo sapiens
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWTVTIFVAGVLTASLTIWKKMG

SEQ ID NO: 1101 - protein, 737 aa, Homo sapiens
MPLNRTLSMSSLPGLEDWEDEFDLENAVLFEVAWEVANKVGGIYTVLQTKAKVTGDEWGDNYFLVGPYTEQGVRTQVELLEAPTPALKRTLDSMNSKGCKVYFGRWLIEGGPLVVLLDVGASAWALERWKGELWDTCNIGVPWYDREANDAVLFGFLTTWFLGEFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYGIYILDRRFRSLDDSCSQLTSFLYSFCQQSRRQRIIQRNRTERLSDLLDWKYLGRYYMSARHMALSKAFPEHFTYEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 1102 - protein, 463 aa, Homo sapiens
MATVTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGELQKRKEVVHTVSLHEIDVINSRTQGFLALFSGDTGEIKSEVREQINAKVAEWREEGKAEIIPGVLFIDEVHMLDIESFSFLNRALESDMAPVLIMATNRGITRIRGTSYQSPHGIPIDLLDRLLIVSTTPYSEKDTKQILRIRCEEEDVEMSEDAYTVLTRIGLETSLRYAIQLITAASLVCRKRKGTEVQVDDIKRVYSLFLDESRSTQYMKEYQDAFLFNELKGETMDTS

SEQ ID NO: 1103 - protein, 141 aa, Homo sapiens
MEMLQGLLLLLLLSMGGAWASREPLRPWCHPINAILAVEKEGCPVCITVNTTICAGYCPTMMRVLQAVLPPLPQVVCTYRDVRFESIRLPGCPRGVDPVVSFPVALSCRCGPCRRSTSDCGGPKDHPLTCDHPQLSGLLFL

SEQ ID NO: 1104 - protein, 437 aa, Homo sapiens
MTQFLPPNLLALFAPRDPIPYLPPLEKLPHEKHHNQPYCGIAPYIREFEDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSAYKHADGKKIDGRRVLVDVERGRTVKGWRPRRLGGGLGGTRRGGADVNIRHSGRDDTSRYDERPGPSPLPHRDRDRDRERERRERSRERDKERERRRSRSRDRRRRSRSRDKEERRRSRERSKDKDRDRKRRSSRSRERARRERERKEELRGGGGDMAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 1105 - protein, 242 aa, Homo sapiens
MGEASPPAPARRHLLVLLLLLSTLVIPSAAAPIHDADAQESSLGLTGLQSLLQGFSRLFLKGNLLRGIDSLFSAPMDFRGLPGNYHKEENQEHQLGNNTLSSHLQIDKMTDNKTGEVLISENVVASIQPAEGSFEGDLKVPRMEEKEALVPIQKATDSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 1106 - protein, 203 aa, Homo sapiens [sequence omitted]

SEQ ID NO: 1107 - protein, 328 aa, Homo sapiens
MMWRPSVLLLLLLLRHGAQGKPSPDAGPHGQGRVHQAAPLSDAPHDDAHGNFQYDHEAFLGREVAKEFDQLTPEESQARLGRIVDRMDRAGDGDGWVSLAELRAWIAHTQQRHIRDSVSAAWDTYDTDRDGRVGWEELRNATYGHYAPGEEFHDVEDAETYKKMLARDERRFRVADQDGDSMATREELTAFLHPEEFPHMRDIVIAETLEDLDRNKDGYVQVEEYIADLYSAEPGEEEPAWVQTERQQFRDFRDLNKDGHLDGSEVGHWVLPPAQDQPLVEANHLLHESDTDKDGRLSKAEILGNWNMFVGSQATNYGEDLTRHHDEL

SEQ ID NO: 1108 - protein, 301 aa, Homo sapiens
MTRHGKNCTAGAVYTYHEKKKDTAASGYGTQNIRLSRDAVKDFDCCCLSLQPCHDPVVTPDGYLYEREAILEYILHQKKEIARQMKAYEKQRGTRREEQKELQRAASQDHVRGFLEKESAIVSRPLNPFTAKALSGTSPDDVQPGPSVGPPSKDKDKVLPSFWIPSLTPEAKATKLEKPSRTVTCPMSGKPLRMSDLTPVHFTPLDSSVDRVGLITRSERYVCAVTRDSLSNATPCAVLRPSGAVVTLECVEKLIRKDMVDPVTGDKLTDRDIIVLQRGGTGFAGSGVKLQAEKSRPVMQA

SEQ ID NO: 1109 - protein, 427 aa, Homo sapiens
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHDPHKIYEFVNSGVGDFSQPDTSPDTNGGGSTSDTQEDILDELLGNMVLAPLPDPGPPSLAVAPEPCPQPLRSPSLDNPTPFPNLGPSENPLKRLLVPGEEWEFEVTAFYRGRQVFQQTISCPEGLRLVGSEVGDRTLPGWPVTLPDPGMSLTDRGVMSYVRHVLSCLGGGLALWRAGQWLWAQRLGHCHTYWAVSEELLPNSGHGPDGEVPKDKEGGVFDLGPFIVDLITFTEGSGRSPRYALWFCVGESWPQDQPWTKRLVMVKVVPTCLRALVEMARVGGASSLENTVDLHISNSHPLSLTSDQYKAYLQDLVEGMDFQGPGES

SEQ ID NO: 1110 - protein, 361 aa, Homo sapiens
MENFVATLANGMSLQPPLEEVSCGQAESSEKPNAEDMTSKDYYFDSYAHFGIHEEMLKDEVRTLTYRNSMFHNRHLFKDKVVLDVGSGTGILCMFAAKAGARKVIGIVCSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 1111 - protein, 343 aa, Homo sapiens
MEVSCGQAESSEKPNAEDMTSKDYYFDSYAHFGIHEEMLKDEVRTLTYRNSMFHNRHLFKDKVVLDVGSGTGILCMFAAKAGARKVIGIVCSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 1112 - protein, 347 aa, Homo sapiens
MVGVAEVSCGQAESSEKPNAEDMTSKDYYFDSYAHFGIHEEMLKDEVRTLTYRNSMFHNRHLFKDKVVLDVGSGTGILCMFAAKAGARKVIGIVCSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 1113 - protein, 416 aa, Homo sapiens
MVRPRRAPYRSGAGGPLGGRGRPPRPLVVRAVRSRSWPASPRGPQPPRIRARSAPPMEGARVFGALGPIGPSSPGLTLGGLAVSEHRLSNKLLAWSGVLEWQEKRRPYSDSTAKLKRTLPCQAYVNQGENLETDQWPQKLIMQLIPQQLLTTLGPLFRNSQLAQFHFTNRDCDSLKGLCRIMGNGFAGCMLFPHISPCEVRVLMLLYSSKKKIFMGLIPYDQSGFVSAIRQVITTRKQAVGPGGVNSGPVQIVNNKFLAWSGVMEWQEPRPEPNSRSKRWLPSHVYVNQGEILRTEQWPRKLYMQLIPQQLLTTLVPLFRNSRLVQFHFTKDLETLKSLCRIMDNGFAGCVHFSYKASCEIRVLMLLYSSEKKIFIGLIPHDQGNFVNGIRRVIANQQQVLQRNLEQEQQQRGMGG

SEQ ID NO: 1114 - protein, 522 aa, Homo sapiens
MSGFNFGGTGAPTGGFTFGTAKTATTTPATGFSFSTSGTGGFNFGAPFQPATSTPSTGLFSLATQTPATQTTGFTFGTATLASGGTGFSLGIGASKLNLSNTAATPAMANPSGFGLGSSNLTNAISSTVTSSQGTAPTGFVFGPSTTSVAPATTSGGFSFTGGSTAQPSGFNIGSAGNSAQPTAPATLPFTPATPAATTAGATQPAAPTPTATITSTGPSLFASIATAPTSSATTGLSLCTPVTTAGAPTAGTQGFSLKAPGAASGTSTTTSTAATATATTTSSSSTTGFALNLKPLAPAGIPSNTAAAVTAPPGPGAAAGAAASSAMTYAQLESLINKWSLELEDQERHFLQQATQVNAWDRTLIENGEKITSLHREVEKVKLDQKRLDQELDFILSQQKELEDLLSPLEELVKEQSGTIYLQHADEEREKTYKLAENIDAQLKRMAQDLKDIIEHLNTSGAPADTSDPLQQICKILNAHMDSLQWIDQNSALLQRKVEEVTKVCEGRRKEQERSFRITFD

SEQ ID NO: 1115 - protein, 522 aa, Homo sapiens; identical to SEQ ID NO: 1114

SEQ ID NO: 1116 - protein, 522 aa, Homo sapiens; identical to SEQ ID NO: 1114

SEQ ID NO: 1117 - protein, 522 aa, Homo sapiens; identical to SEQ ID NO: 1114

SEQ ID NO: 1118 - protein, 461 aa, Homo sapiens
MSSPTTSSLDTPLPGNGPPQPGAPSSSPTVKEEGPEPWPGGPDPDVPGTDEASSACSTDWVIPDPEEEPERKRKKGPAPKMLGHELCRVCGDKASGFHYNVLSCEGCKGFFRRSVVRGGARRYACRGGGTCQMDAFMRRKCQQCRLRKCKEAGMREQCVLSEEQIRKKKIRKQQQQESQSQSQSPVGPQGSSSSASGPGASPGGSEAGSQGSGEGEGVQLTAAQELMIQQLVAAQLQCNKRSFSDQPKVTPWPLGADPQSRDARQQRFAHFTELAIISVQEIVDFAKQVPGFLQLGREDQIALLKASTIEIMLLETARRYNHETECITFLKDFTYSKDDFHRAGLQVEFINPIFEFSRAMRRLGLDDAEYALLIAINIFSADRPNVQEPGRVEALQQPYVEALLSYTRIKRPQDQLRFPRMLMKLVSLRTLSSVHSEQVFALRLQDKKLPPLLSEIWDVHE

SEQ ID NO: 1119 - protein, 277 aa, Homo sapiens
MWPLALVIASLTLALSGGVSQESSKVLNTNGTSGFLPGGYTCFPHSQPWQAALLVQGRLLCGGVLVHPKWVLTAAHCLKEGLKVYLGKHALGRVEAGEQVREVVHSIPHPEYRRSPTHLNHDHDIMLLELQSPVQLTGYIQTLPLSHNNRLTPGTTCRVSGWGTTTSPQVNYPKTLQCANIQLRSDEECRQVYPGKITDNMLCAGTKEGGKDSCEGDSGGPLVCNRTLYGIVSWGDFPCGQPDRPGVYTRVSRYVLWIRETIRKYETQQQKWLKGPQ

SEQ ID NO: 1120 - protein, 463 aa, Homo sapiens
MAQGLVTFADVAIDFSQEEWACLNSAQRDLYWDVMLENYSNLVSLDLESAYENKSLPTKKNIHEIRASKRNSDRRSKSLGRNWICEGTLERPQRSRGRYVNQMIINYVKRPATREGTPPRTHQRHHKENSFECKDCGKAFSRGYQLSQHQKIHTGEKPYECKECKKAFRWGNQLTQHQKIHTGEKPYECKDCGKAFRWGSSLVIHKRIHTGEKPYECKDCGKAFRRGDELTQHQRFHTGEKDYECKDCGKTFSRVYKLIQHKRIHSGEKPYECKDCGKAFICGSSLIQHKRIHTGEKPYECQECGKAFTRVNYLTQHQKIHTGEKPHECKECGKAFRWGSSLVKHERIHTGEKPYKCTECGKAFNCGYHLTQHERIHTGETPYKCKECGKAFIYGSSLVKHERIHTGVKPYGCTECGKSFSHGHQLTQHQKTHSGAKSYECKECGKACNHLNHLREHQRIHNS

SEQ ID NO: 1121 - protein, 499 aa, Homo sapiens
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLDEACDMALELNASKHRIYEYVESRMSFIAPNLSIIIGASTAAKIMGVAGGLTNLSKMPACNIMLLGAQRKTLSGFSSTSVLPHTGYIYHSDIVQSLPPDLRRKAARLVAAKCTLAARVDSFHESTEGKVGYELKDEIERKFDKWQEPPPVKQVKPLPAPLDGQRKKRGGRRYRKMKERLGLTEIRKQANRMSFGEIEEDAYQEDLGFSLGHLGKSGSGRVRQTQVNEATKARISKTLQRTLQKQSVVYGGKSTIRDRSSGTASSVAFTPLQGLEIVNPQAAEKKVAEANQKYFSSMAEFLKVKGEKSGLMST

SEQ ID NO: 1122 - protein, 753 aa, Homo sapiens
MADKRKLQGEIDRCLKKVSEGVEQFEDIWQKLHNAANANQKEKYEADLKKEIKKLQRLRDQIKTWVASNEIKDKRQLIDNRKLIETQMERFKVVERETKTKAYSKEGLGLAQKVDPAQKEKEEVGQWLTNTIDTLNMQVDQFESEVESLSVQTRKKKGDKDKQDRIEGLKRHIEKHRYHVRMLETILRMLDNDSILVDAIRKIKDDVEYYVDSSQDPDFEENEFLYDDLDLEDIPQALVATSPPSHSHMEDEIFNQSSSTPTSTTSSSPIPPSPANCTTENSEDDKKRGRSTDSEVSQSPAKNGSKPVHSNQHPQSPAVPPTYPSGPPPAASALSTTPGNNGVPAPAAPPSALGPKASPAPSHNSGTPAPYAQAVAPPAPSGPSTTQPRPPSVQPSGGGGGGSGGGGSSSSSNSSAGGGAGKQNGATSYSSVVADSPAEVALSSSGGNNASSQALGPPSGPHNPPPSTSKEPSAAAPTGAGGVAPGSGNNSGGPSLLVPLPVNPPSSPTPSFSDAKAAGALLNGPPQFSTAPEIKAPEPLSSLKSMAERAAISSGIEDPVPTLHLTERDIILSSTSAPPASAQPPLQLSEVNIPLSLGVCPLGPVPLTKEQLYQQAMEEAAWHHMPHPSDSERIRQYLPRNPCPTPPYHHQMPPPHSDTVEFYQRLSTETLFFIFYYLEGTKAQYLAAKALKKQSWRFHTKYMMWFQRHEEPKTITDEFEQGTYIYFDYEKWGQRKKEGFTFEYRYLEDRDLQ

SEQ ID NO: 1123 - protein, 472 aa, Homo sapiens
MSPEEWTYLVVLLISIPIGFLFKKAGPGLKRWGAAAVGLGLTLFTCGPHTLHSLVTILGTWALIQAQPCPCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSSPEKAASLEYDYETIRNIDCYSTDFCVRVRDGMRYWNMTVQWWLAQYIYKSAPARSYVLRSAWTMLLSAYWHGLHPGYYLSFLTIPLCLAAEGRLESALRGRLSPGGQKAWDWVHWFLKMRAYDYMCMGFVLLSLADTLRYWASIYFCIHFLALAALGLGLALGGGSPSRRKAASQPTSLAPEKLREE

SEQ ID NO: 1124 - protein, 390 aa, Homo sapiens
MLVVEVANGRSLVWGAEAVQALRERLGVGGRTVGALPRGPRQNSRLGLPLLLMPEEARLLAEIGAVTLVSAPRPDSRHHSLALTSFKRQQEESFQEQSALAAEARETRRQEVLEKITEGQAAKKQKLEQASGASSSQEAGSSQAAKEDETSDGQASGEQEEAGPSSSQAGPSNGVAPLPRSALLVQLATARPRPVKARPLDWRVQSKDWPHAGRPAHELRYSIYRDLWERGFFLSAAGKFGGDFLVYPGDPLRFHAHYIAQCWAPEDTSHSKTWLLLGALEPASERPCSSVLRSLMVRWSTPPCNGPACSELQRPRGCGCVGSKSLSGCSPALLWESRTSSYLSPRLVFDSRFSNTTSFLCSSLFQSTYWLCFCSYLFSHCELPENGAWV

SEQ ID NO: 1125 - protein, 194 aa, Homo sapiens [sequence omitted]

SEQ ID NO: 1126 - protein, 386 aa, Homo sapiens
  VARIANT 104, 154: Xaa = Any Amino Acid
MFPEPPTPGPPSPDTPPDSSRISHGPVPPWALATIVLVSGLLIFSCCFCLYRKSCRRRTGKKSQAQAQVHLQEVKGLGQSYIDKVQPEVEELEPAPSGPGQQVXDKHELGRLQYSLDYDFQSGQLLVGILQAMGLAALDLGGSSDPYVRVYLLXDKRRRYETKVHRQTLNPHFGETFAFKVPYVELGGRVLVMAVYDFDRFSRNDAIGEVRVPMSSVDLGRPVQAWRELQAAPREEQEKLGDICFSLRYVPTAGKLTVIVLEAKNLKKMDVGGLSDPYVKVHLLQGGKKVRKKKTTIKKNTLNPYYNEAFSFEVPCDQVQKVQVELTVLDYDKLGKNEAIGRVAVGAAAGGAGLRHWADMLANPRRPIAQWHSLRPPDRVRLLPAP

SEQ ID NO: 1127 - protein, 172 aa, Homo sapiens
MLLLPPRPPHPRSSSPEAMDPPPPKAPPFPKAEGPSSTPSSAAGPRPPRLGRHLLIDANGVPYTYTVQLEEEPRGPPQREAPPGEPGPRKGYSCPECARVFASPLRLQSHRVSHSDLKPFTCGACGKAFKRSSHLSRHRATHRARAGPPHTCPLCPRRFQDAAELAQHVRLH

SEQ ID NO: 1128 - protein, 475 aa, Homo sapiens
MSDFDEFERQLNENKQERDKENRHRKRSHSRSRSRDRKRRSRSRDRRNRDQRSASRDRRRRSKPLTRGAKEEHGGLIRSPRHEKKKKVRKYWDVPPPGFEHITPMQYKAMQAAGQIPATALLPTMTPDGLAVTPTPVPVVGSQMTRQARRLYVGNIPFGITEEAMMDFFNAQMRLGGLTQAPGNPVLAVQINQDKNFAFLEFRSVDETTQAMAFDGIIFQGQSLKIRRPHDYQPLPGMSENPSVYVPGVVSTVVPDSAHKLFIGGLPNYLNDDQVKELLTSFGPLKAFNLVKDSATGLSKGYAFCEYVDINVTDQAIAGLNGMQLGDKKLLVQRASVGAKNATLVSPPSTINQTPVTLQVPGLMSSQVQMGGHPTEVLCLMNMVLPEELLDDEEYEEIVEDVRDECSKYGLVKSIEIPRPVDGVEVPGCGKIFVEFTSVFDCQKAMQGLTGRKFANRVVVTKYCDPDSYHRRDFW

SEQ ID NO: 1129 - protein, 550 aa, Homo sapiens
MSTSSLRRQMKNIVHNYSEAEIKVREATSNDPWGPSSSLMSEIADLTYNVVAFSEIMSMIWKRLNDHGKNWRHVYKAMTLMEYLIKTGSERVSQQCKENMYAVQTLKDFQYVDRDGKDQGVNVREKAKQLVALLRDEDRLREERAHALKTKEKLAQTATASSAAVGSGPPPEAEQAWPQSSGEEELQLQLALAMSKEEADQEERIRRGDDLRLQMAIEESKRETGGKEESSLMDLADVFTAPAPAPTTDPWGGPAPMAAAVPTAAPTSDPWGGPPVPPAADPWGGPAPTPASGDPWRPAAPAGPSVDPWGGTPAPAAGEGPTPDPWGSSDGGVPVSGPSASDPWTPAPAFSDPWGGSPAKPSTNGTTAGGFDTEPDEFSDFDRLRTALPTSGSSAGELELLAGEVPARSPGAFDMSGVRGSLAEAVGSPPPAATPTPTPPTRKTPESFLGPNAALVDLDSLVSRPGPTPPGAKASNPFLPGGGPATGPSVTNPFQPAPPATLTLNQLRLSPVPPVPGAPPTYISPLGGGPGLPPMMPPGPPAPNTNPFLL

SEQ ID NO: 1130 - protein, 407 aa, Homo sapiens
MYTVLLGSGQASSRPVLGVLGDPDMELREEAWSPGPLDSEDQQMASHENPVDILIMDDDDVPSWPPTKLSPPQSAPPAGPPPRPRPPAPYICNECGKSFSHWSKLTRHQRTHTGERPNACADCGKTFSQSSHLVQHRRIHTGEKPYACLECGKRFSWSSNLMQHQRIHTGEKPYTCPDCGRSFTQSKSLAKHRRSHSGLKPFVCPRCGRGFSQPKSLARHLRLHPELSGPGVAAKVLAASVRRAKGPEEAVAADGEIAIPVGDGEGIIVVGAPGEGAAAAAAMAGAGAKAAGPRSRRAPAPKPYVCLECGKGFGHGAGLLAHQRAQHGDGLGAAGGEEPAHICVECGEGFVQGAALRRHKKIHAVGAPSVCSSCGQSYYRAGGEEEDDDDDEAAGGRCPECRGGEGR

SEQ ID NO: 1131 - protein, 327 aa, Homo sapiens
MEVAVPVKQEAEGLALDSPWHRFRRFHLGDAPGPREALGLLRALCRDWLRPEVHTKEQMLELLVLEQFLSALPADTQAWVCSRQPQSGEEAVALLEELWGPAASPDGSSATRVPQDVTQGPGATGGKEDSGMIPLAGTAPGAEGPAPGDSQAVRPYKQEPSSPPLAPGLPAFLAAPGTTSCPECGKTSLKPAHLLRHRQSHSGEKPHACPECGKAFRRKEHLRRHRDTHPGSPGSPGPALRPLPAREKPHACCECGKTFYWREHLVRHRKTHSGARPFACWECGKGFGRREHVLRHQRIHGRAAASAQGAVAPGPDGGGPFPPWPLG

SEQ ID NO: 1132 - protein, 327 aa, Homo sapiens; identical to SEQ ID NO: 1131

SEQ ID NO: 1133 - protein, 627 aa, Homo sapiens
MAAAVLTDRAQVSVTFDDVAVTFTKEEWGQLDLAQRTLYQEVMLENCGLLVSLGCPVPKAELICHLEHGQEPWTRKEDLSQDTCPGDKGKPKTTEPTTCEPALSEGISLQGQVTQGNSVDSQLGQAEDQDGLSEMQEGHFRPGIDPQEKSPGKMSPECDGLGTADGVCSRIGQEQVSPGDRVRSHNSCESGKDPMIQEEENNFKCSECGKVFNKKHLLAGHEKIHSGVKPYECTECGKTFIKSTHLLQHHMIHTGERPYECMECGKAFNRKSYLTQHQRIHSGEKPYKCNECGKAFTHRSNFVLHNRRHTGEKSFVCTECGQVFRHRPGFLRHYVVHSGENPYECLECGKVFKHRSYLMWHQQTHTGEKPYECSECGKVFLESAALIHHYVIHTGEKPFECLECGKAFNHRSYLKRHQRIHTGEKPFVCSECGKAFTHCSTFILHKRAHTGEKPFECKECGKAFSNRKDLIRHFSIHTGEKPYECVECGKAFTRMSGLTRHKRIHSGEKPYECVECGKSFCWSTNLIRHAIIHTGEKPYKCSECGKAFSRSSSLTQHQRMHTGKNPISVTDVGRPFTSGQTSVTLRELLLGKDFLNVTTEANILPEETSSSASDQPYQRETPQVSSL

SEQ ID NO: 1134 - protein, 562 aa, Homo sapiens
MAAAWMAPAQESVTFEDVAVTFTQEEWGQLDVTQRALYVEVMLETCGLLVALGDSTKPETVEPIPSHLALPEEVSLQEQLAQGVPRYSYLGQAMDQDGPSEMQEYFLRPGTDPQSEKLHGKMSLEHEGLATADGICSMMIQNQVSPEDALYGFDSYGPVTDSLIHEGENSYKFEEMFNENCFLVQHEQILPRVKPYDCPECGKAFGKSKHLLQHHIIHTGEKPYKCLECGKDFNRRSHLTRHQRTHNGDKPFVCSECGRTFNRGSHLTRHQRVHSGEKPFVCNECGKAFTYRSNFVLHNKSHNEKKPFACSECGKGFYESTALIQHFIIHTGERPFKCLECGKAFNCRSHLKQHERIHTGEKPFVCSQCGKAFTHYSTYVLHERAHTGEKPFECKECGKAFSIRKDLIRHFNIHTGEKPYECLQCGKAFTRMSGLTRHQWIHTGEKPYVCTQCGKAFCRTTNLIRHFSIHTGEKPYECVECGKAFNRRSPLTRHQRIHTAEKSHEPIQSGNVSCESTDLIQHSIIHTESSPVSAVNMETPSIAAHSSSLDINGFIVEETLPL

SEQ ID NO: 1135 - protein, 659 aa, Homo sapiens
MAAAVLMDRVQSCVTFEDVFVYFSREEWELLEEAQRFLYRDVMLENFALVATLGFWCEAEHEAPSEQSVSVEGVSQVRTAESGLFQKAHPCEMCDPLLKDILHLAEHQGSHLTQKLCTRGLCRRRFSFSANFYQHQKQHNGENCFRGDDGGASFVKSCTVHMLGRSFTCREEGMDLPDSSGLFQHQTTYNRVSPCRRTECMESFPHSSSLRQHQGDYDGQMLFSCGDEGKAFLDTFTLLDSQMTHAEVRPFRCLPCGNVFKEKSALINHRKIHSGEISHVCKECGKAFIHLHHLKMHQKFHTGKRHYTCSECGKAFSRKDTLAQHQRVHTGERPYDCSECGKAYSRSSHLVQHQRIHTGERPYKCNECGKAFSRKDTLVQHQRFHTGERPYECSECGKFFSQSSHLIEHWRIHTGARPYECIECGKFFSHNSSLIKHRRVHTGASSYVCSKCGKAFGCKDTLVQHQIIHTGARPYECSECGKAFSRKDTLVQHQKIHTGERPYECGECGKFFSHSSNLIVHQRIHTGAKPYECNECGKCFSHNSSLILHQRVHTGARPYVCSECGKAYISSSHLVQHKKVHTGARPYECSECGKFFSRNSGLILHQRVHTGEKPYVCSECGKAYSRSSHLVRHQKAHTGERAHECNSFGGPLAASLKLV

SEQ ID NO: 1136 - protein, 510 aa, Homo sapiens
MAAAALRDPAQVPVAADLLTDHEEGYVTFEDVAVYFSQEEWRLLDDAQRLLYRNVMLENFTLLASLGLASSKTHEITQLESWEEPFMPAWEVVTSAIPRGCWHGAEAEEAPEQIASVGLLSSNIQQHQKQHCGEKPLKRQQGRVPVLRSCKVHLSEKSLQSREVGKALLISSGVLKHQVTHTGEKSHRSSKSREAFHAGKRHYKCSECGKAFGQKYLLVQHQRLHAGKKTYECSECGKLFRDMSNLFIHQIVHTGERPYGCSNCGKSFSRNAHLIEHQRVHTGEKPFTCSECGKAFRHNSTLVQHHKIHTGVRPYECSECGKLFSFNSSLMKHQRVHTGERPYKCSECGKFYSHKSNLIKHWRVHTGERPYKCSDCGKFFTQCSSLMQHQKVHTGEKPFKCNECGRFFRENSTLVRHQRVHTGAKPYECRECGKFFSQSSTLMQHRKVHIGEKPFKCNECGRLFRENSSLVKHQRVHTGAKPYECRECGKFFRHNSSLFKHRRIHTGEMQ

SEQ ID NO: 1137 - protein, 510 aa, Homo sapiens; identical to SEQ ID NO: 1136

SEQ ID NO: 1138 - protein, 348 aa, Homo sapiens
MWGMWETILVQCNLHQYQKCYSIEQPLRRDKSEASIVKNCTVSKEPHPSEKPFTCKEEQKNFQATLGGCQQKAIHSKRKTHRSTESGDAFHGEQMHYKCSECGKAFSRKDTLVQHQRIHSGEKPYECSECGKAFSRKATLVQHQRIHTGERPYECSECGKTFSRKDNLTQHKRIHTGEMPYKCNECGKYFSHHSNLIVHQRVHNGARPYKCSDCGKVFRHKSTLVQHESIHTGENPYDCSDCGKSFGHKYTLIKHQRIHTESKPFECIECGKFFSRSSDYIAHQRVHTGERPFVCSKCGKDFIRTSHLVRHQRVHTGERPYECSECGKAYSLSSHLNRHQKVHTAGRL

SEQ ID NO: 1139 - protein, 577 aa, Homo sapiens
MLGFPPGRPQLPVQLRPQTRMATALRDPASVPIATEVLFKLTQGSVTFEDVAVYFSWEEWDLLDEAQKHLYFDVMLENFALTSSLGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 1140 - protein, 564 aa, Homo sapiens
MLGFPPGRPQLPVQLRPQTRMATALRDPASGSVTFEDVAVYFSWEEWDLLDEAQKHLYFDVMLENFALTSSLGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 1141 - protein, 304 aa, Homo sapiens
MKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDLQLELNSESEVGTPGGRGLPVRAPLSTLNGEISALTAEAACVPADDRILCRMKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDLQLELNSESEVGTPGGRGLPVRAPLSTLNGEISALTAEVRSRSDH

SEQ ID NO: 1142 - protein, 149 aa, Homo sapiens
MKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDLQLELNSESEVGTPGGRGLPVRAPLSTLNGEISALTAEVRSRSDH

SEQ ID NO: 1143 - protein, 51 aa, Homo sapiens
MVAYWRQAGLSYIRYSQICAKAVRDALKTEFKANAEKTSGSNVKIVKVKKE

SEQ ID NO: 1144 - protein, 211 aa, Homo sapiens
MKIWTSEHVFDHPWETVTTAAMQKYPNPMNPSVVGVDVLDRHIDPSGKLHSHRLLSTEWGLPSIVKSLIGAARTKTYVQEHSVVDPVEKTMELKSTNISFTNMVSVDERLIYKPHPQDPEKTVLTQEAIITVKGVSLSSYLEGLMASTISSNASKGREAMEWVIHKLNAEIEELTASARGTIRTPMAAAAFCREVIVTVGRQHRVLQVSPN

SEQ ID NO: 1145 - protein, 299 aa, Homo sapiens
MSRGPSSAVLPSALGSRKLGPRSLSCLSDLDGGVALEPRACRPPGSPGRAPPPTPAPSGCDPRLRPIILRRARSLPSSPERRQKAAGAPGAACRPGCSQKLRVRFADALGLELAQVKVFNAGDDPSVPLHVLSRLAINSDLCCSSQDLEFTLHCLVPDFPPPVEAADFGERLQRQLVCLERVTCSDLGISGTVRVCNVAFEKQVAVRYTFSGWRSTHEAVARWRGPAGPEGTEDVFTFGFPVPPFLLELGSRVHFAVRYQVAGAEYWDNNDHRDYSLTCRNHALHMPRGECEESWIHFI

SEQ ID NO: 1146 - protein, 1083 aa, Homo sapiens
MAAGSDLLDEVFFNSEVDEKVVSDLVGSLESQLAASAAHHHHLAPRTPEVRAAAAGALGNHVVSGSPAGAAGAGPAAPAEGAPGAAPEPPPAGRARPGGGGPQRPGPPSPRRPLVPAGPAPPAAKLRPPPEGSAGACAPVPAAAAVAAGPEPAPAGPAKPAGPAALAARAGPGPGPGPGPGPGPGKPAGPGAAQTLNGSAALLNSHHAAAPAVSLVNNGPAALLPLPKPAAPGTVIQTPPFVGAAAPPAPAAPSPPAAPAPAAPAAAPPPPPPAPATLARPPGHPAGPPTAAPAVPPPAAAQNGGSAGAAPAPAPAAGGPAGVSGQPGPGAAAAAPAPGVKAESPKRVVQAAPPAAQTLAASGPASTAASMVIGPTMQGALPSPAAVPPPAPGTPTGLPKGAAGAVTQSLSRTPTATTSGIRATLTPTVLAPRLPQPPQNPTNIQNFQLPPGMVLVRSENGQLLMIPQQALAQMQAQAHAQPQTTMAPRPATPTSAPPVQISTVQAPGTPIIARQVTPTTIIKQVSQAQTTVQPSATLQRSPGVQPQLVLGGAAQTASLGTATAVQTGTPQRTVPGATTTSSAATETMENVKKCKNFLSTLIKLASSGKQSTETAANVKELVQNLLDGKIEAEDFTSRLYRELNSSPQPYLVPFLKRSLPALRQLTPDSAAFIQQSQQQPPPPTSQATTALTAVVLSSSVQRTAGKTAATVTSALQPPVLSLTQPTQVGVGKQGQPTPLVIQQPPKPGALIRPPQVTLTQTPMVALRQPHNRIMLTTPQQIQLNPLQPVPVVKPAVLPGTKALSAVSAQAAAAQKNKLKEPGGGSFRDDDDINDVASMAGVNLSEESARILATNSELVGTLTRSCKDETFLLQAPLQRRILEIGKKHGITELHPDVVSYVSHATQQRLQNLVEKISETAQQKNFSYKDDDRYEQASDVRAQLKFFEQLDQIEKQRKDEQEREILMRAAKSRSRQEDPEQLRLKQKAKEMQQQELAQMRQRDANLTALAAIGPRKKRKVDCPGPGSGAEGSGPGSVVPGSSGVGTPRQFTRQRITRVNLRDLIFCLENERETSHSLLLYKAFLK

SEQ ID NO: 1147 - protein, 396 aa, Homo sapiens
MSVAFASARPRGKGEVTQQTIQKMLDENHHLIQCILEYQSKGKTAECTQYQQILHRNLVYLATIADSNQNMQSLLPAPPTQNMNLGPGALTQSGSSQGLHSQGSLSDAISTGLPPSSLLQGQIGNGPSHVSMQQTAPNTLPTTSMSISGPGYSHAGPASQGVPMQGQGTIGNYVSRTNINMQSNPVSMMQQQAATSHYSSAQGGSQHYQGQSSIAMMGQGSQGSSMMGQRPMAPYRPSQQGSSQQYLGQEEYYGEQYSHSQGAAEPMGQQYYPDGHGDYAYQQSSYTEQSYDRSFEESTQHYYEGGNSQYSQQQAGYQQGAAQQQTYSQQQYPSQQSYPGQQQGYGSAQGAPSQYPGYQQGQGQQYGSYRAPQTAPSAQQQRPYGYEQGQYGNYQQ

SEQ ID NO: 1148 - protein, 396 aa, Homo sapiens; identical to SEQ ID NO: 1147

SEQ ID NO: 1149 - protein, 248 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEVVQSGGKNIELAVMRRDQSLKILNPEEIEKYVAEIEKEKEENEKKKQKKAS

SEQ ID NO: 1150 - protein, 166 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQVGACPLACSPLAAGQSRLRHGGSCHVTSALYAEQWAQAVWHLCPHRGFRL

SEQ ID NO: 1151 - protein, 468 aa, Homo sapiens
MNGEEEFFDAVTEANQKVTGMIDLDTSKNNRIGKTGERPSQENGIQKHRTSLPAPMFSRSDFSVWTILKKCVGLELSKITMPIAFNEPLSFLQRITEYMEHVYLIHRASCQPQPLERMQSVAAFAVSAVASQWERTGKPFNPLLGETYELIREDLGFRFISEQVSHHPPISAFHSEGLNHDFLFHGSIYPKLKFWGKSVEAEPRGTITLELLKHNEAYTWTNPTCCVHNVIIGKLWIEQYGTVEILNHRTGHKCVLHFKPCGLFGKELHKVEGHIQDKNKKKLFMIYGKWTECLWGIDPVSYESFKKQERRGDHLRKAKLDEDSGKADSDVADDVPVAQETVQVIPGSKLLWRINTRPPNSAQMYNFTSFTVSLNELETGMEKTLPPTDCRLRPDIRGMENGNMDLASQEKERLEEKQREARRERAKEEAEWQTRWFYPGNNPYTGTPDWLYAGDYFERNFSDCPDIY

SEQ ID NO: 1152 - protein, 480 aa, Homo sapiens
MNGEEEFFDAVTGFDSDNSSGEFSEANQKVTGMIDLDTSKNNRIGKTGERPSQENGIQKHRTSLPAPMFSRSDFSVWTILKKCVGLELSKITMPIAFNEPLSFLQRITEYMEHVYLIHRASCQPQPLERMQSVAAFAVSAVASQWERTGKPFNPLLGETYELIREDLGFRFISEQVSHHPPISAFHSEGLNHDFLFHGSIYPKLKFWGKSVEAEPRGTITLELLKHNEAYTWTNPTCCVHNVIIGKLWIEQYGTVEILNHRTGHKCVLHFKPCGLFGKELHKVEGHIQDKNKKKLFMIYGKWTECLWGIDPVSYESFKKQERRGDHLRKAKLDEDSGKADSDVADDVPVAQETVQVIPGSKLLWRINTRPPNSAQMYNFTSFTVSLNELETGMEKTLPPTDCRLRPDIRGMENGNMDLASQEKERLEEKQREARRERAKEEAEWQTRWFYPGNNPYTGTPDWLYAGDYFERNFSDCPDIY

SEQ ID NO: 1153 - protein, 3695 aa, Homo sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPKGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRPCDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVFLRRVALEVASPAGQGALASNVELCLCPASYRGDSCQECAPGFYRDVKGLFLGRCVPCQCHGHSDRCLPGSGVCVDCQHNTEGAHCERCQAGFVSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFDGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRRLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLDLPGATLPDVGLELEVRPLAVTGLIFHLGQARTPPYLQLQVTEKQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 1154 - protein, 83 aa, Homo sapiens
MQNDAGEFVDLYVPRKCSASNRIIGAKDHASIQMNVAEVDKVTGRFNGQFKTYAICGAIRRMGESDDSILRLAKADGIVSKNF

SEQ ID NO: 1155 - protein, 500 aa, Homo sapiens
MSGPGPREPPPEAGAAGGEAAVEGAGGGDAALGEPGLSFTTTDLSLVEMTEVEYTQLQHILCSHMEAAADGELETRLNSALLAAAGPGAGAGGFAAGGQGGAAPVYPVLCPSALAADAPCLGHIDFQELRMMLLSEAGAAEKTSGGGDGARARADGAAKEGAGAAAAAAGPDGAPEARAKPAVRVRLEDRFNSIPAEPPPAPRGPEPPEPGGALNNLVTLIRHPSELMNVPLQQQNKCTALVKNKTAATTTALQFTYPLFTTNACSTSGNSNLSQTQSSSNSCSVLEAAKHQDIGLPRAFSFCYQQEIESTKQTLGSRNKVLPEQVWIKVGEAALCKQALKRNRSRMRQLDTNVERRALGEIQNVGEGATATQGAWQSSESSQANLGEQAQSGPQGGRSQRRERHNRMERDRRRRIRICCDELNLLVPFCNAETDKATTLQWTTAFLKYIQERHGDSLKKEFESVFCGKTGRRLKLTRPDSLVTCPAQGSLQSSPSMEIK

SEQ ID NO: 1156 - protein, 228 aa, Homo sapiens
MSYAEKPDEITKDEWMEKLNNLHVQRADMNRLIMNYLVTEGFKEAAEKFRMESGIEPSVDLETLDERIKIREMILKGQIQEAIALINSLHPELLDTNRYLYFHLQQQHLIELIRQRETEAALEFAQTQLAEQGEESRECLTEMERTLALLAFDSPEESPFGDLLHTMQRQKVWSEVNQAVLDYENRESTPKLAKLLKLLLWAQNELDQKKVKYPKMTDLSKGVIEEPK

SEQ ID NO: 1157 - protein, 559 aa, Homo sapiens
MSATSVDTQRTKGQDNKVQNGSLHQKDTVHDNDFEPYLTGQSNQSNSYPSMSDPYLSSYYPPSIGFPYSLNEAPWSTAGDPPIPYLTTYGQLSNGDHHFMHDAVFGQPGGLGNNIYQHRFNFFPENPAFSAWGTSGSQGQQTQSSAYGSSYTYPPSSLGGTVVDGQPGFHSDTLSKAPGMNSLEQGMVGLKIGDVSSSAVKTVGSVVSSVALTGVLSGNGGTNVNMPVSKPTSWAAIASKPAKPQPKMKTKSGPVMGGGLPPPPIKHNMDIGTWDNKGPVPKAPVPQQAPSPQAAPQPQQVAQPLPAQPPALAQPQYQSPQQPPQTRWVAPRNRNAAFGQSGGAGSDSNSPGNVQPNSAPSVESHPVLEKLKAAHSYNPKEFEWNLKSGRVFIIKSYSEDDIHRSIKYSIWCSTEHGNKRLDSAFRCMSSKGPVYLLFSVNGSGHFCGVAEMKSPVDYGTSAGVWSQDKWKGKFDVQWIFVKDVPNNQLRHIRLENNDNKPVTNSRDTQEVPLEKAKQVLKIISSYKHTTSIFDDFAHYEKRQEEEEVVRKERQSRNKQ

SEQ ID NO: 1158 - protein, 201 aa, Homo sapiens
MYTLLSGLYKYMFQKDEYCILILGLDNAGKTTFLEQSKTRFNKNYKGMSLSKITTTVGLNIGTVDVGKARLMFWDLGGQEELQSLWDKYYAECHGVIYVIDSTDEERLAESKQAFEKVVTSEALCGVPVLVLANKQDVETCLSIPDIKTAFSDCTSKIGRRDCLTQACSALTGKGVREGIEWMVKCVVRNVHRPPRQRDIT

SEQ ID NO: 1159 - protein, 531 aa, Homo sapiens
MDEESLESALQTYRAQLQQVELALGAGLDSSEQADLRQLQGDLKELIELTEASLVSVRKSRLLAALDEERPGRQEDAEYQAFREAITEAVEAPAAARGSGSETVPKAEAGPESAAGGQEEEEGEDEEELSGTKVSAPYYSSWGTLEYHNAMVVGTEEAEDGSAGVRVLYLYPTHKSLKPCPFFLEGKCRFKENCRFSHGQVVSLDELRPFQDPDLSSLQAGSACLAKHQDGLWHAARITDVDNGYYTVKFDSLLLREAVVEGDGILPPLRTEATESDSDSDGTGDSSYARVVGSDAVDSAQSSALCPSLAVVGSDAVDSGTCSSAFAGWEVHTRGIGSRLLTKMGYEFGKGLGRHAEGRVEPIHAVVLPRGKSLDQCVETLQKQTRVGKAGTNKPPRCRGRGARPGGRPAPRNVFDFLNEKLQGQAPGALEAGAAPAGRRSKDMYHASKSAKRALSLRLFQTEEKIERTQRDIRSIQEALARNAGRHSVASAQLQEKLAGAQRQLGQLRAQEAGLQQEQRKADTHKKMTEF

SEQ ID NO: 1160 - protein, 318 aa, Homo sapiens
MDEESLESALQTYRAQLQQVELALGAGLDSSEQADLRQLQGDLKELIELTEASLVSVRKSRLLAALDEERPGRQEDAEYQAFREAITEAVEAPAAARGSGSETVPKAEAGPESAAGGQEEEEGEDEEELSGTKVSAPYYSSWGTLEYHNAMVVGTEEAEDGSAGVRVLYLYPTHKSLKPCPFFLEGKCRFKENCRFSHGQVVSLDELRPFQDPDLSSLQAGSACLAKHQDGLWHAARITDVDNGYYTVKFDSLLLREAVVEGDGILPPLRTEATESDSDSDGTGDSSYARGMAAAAEPRSQEGGVTLRGSWPVRAPTI

SEQ ID NO: 1161 - protein, 511 aa, Homo sapiens
MDEESLESALQTYRAQLQQVELALGAGLDSSEQADLRQLQGDLKELIELTEASLVSVRKSRLLAALDEERPGRQEDAEYQAFREAITEAVEAPAAARGSGSETVPKAEAGPESAAGGQEEEEGEDEEELSGTKVSAPYYSSWGTLEYHNAMVVGTEEAEDGSAGVRVLYLYPTHKSLKPCPFFLEGKCRFKENCRFSHGQVVSLDELRPFQDPDLSSLQAGSACLAKHQDGLWHAARITDVDNGYYTVKFDSLLLREAVVEGDGILPPLRTEATESDSDSDGTGDSSYARVVGSDAVDSGTCSSAFAGWEVHTRGIGSRLLTKMGYEFGKGLGRHAEGRVEPIHAVVLPRGKSLDQCVETLQKQTRVGKAGTNKPPRCRGRGARPGGRPAPRNVFDFLNEKLQGQAPGALEAGAAPAGRRSKDMYHASKSAKRALSLRLFQTEEKIERTQRDIRSIQEALARNAGRHSVASAQLQEKLAGAQRQLGQLRAQEAGLQQEQRKADTHKKMTEF

SEQ ID NO: 1162 - protein, 201 aa, Homo sapiens; identical to SEQ ID NO: 1158

SEQ ID NO: 1163 - protein, 531 aa, Homo sapiens; identical to SEQ ID NO: 1159

SEQ ID NO: 1164 - protein, 318 aa, Homo sapiens; identical to SEQ ID NO: 1160

SEQ ID NO: 1165 - protein, 511 aa, Homo sapiens; identical to SEQ ID NO: 1161

SEQ ID NO: 1166 - protein, 206 aa, Homo sapiens
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYVKTSEKLGEWNEKVTQSDLYKKTQETLSQAGQKTSAALSTVGSAISRKLGDMRNSATFKSFEDRVGTIKSKVVGDRENGSDNLPSSAGSGDKPLSDPAPF

SEQ ID NO: 1167 - protein, 186 aa, Homo sapiens
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYKKTQETLSQAGQKTSAALSTVGSAISRKLGDMRNSATFKSFEDRVGTIKSKVVGDRENGSDNLPSSAGSGDKPLSDPAPF

SEQ ID NO: 1168 - protein, 229 aa, Homo sapiens
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYVKTSEKLGEWNEKVTQSDLYKKTQETLSQAGQKTSAALSTVGSAISRKLGDMRAHPFSHSFSSYSIRHSISMPAMRNSATFKSFEDRVGTIKSKVVGDRENGSDNLPSSAGSGDKPLSDPAPF

SEQ ID NO: 1169 - protein, 209 aa, Homo sapiens
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYKKTQETLSQAGQKTSAALSTVGSAISRKLGDMRAHPFSHSFSSYSIRHSISMPAMRNSATFKSFEDRVGTIKSKVVGDRENGSDNLPSSAGSGDKPLSDPAPF

SEQ ID NO: 1170 - protein, 220 aa, Homo sapiens
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYVKTSEKLGEWNEKVTQSDLYKKTQETLSQAGQKTSAALSTVGSAISRKLGDMSSYSIRHSISMPAMRNSATFKSFEDRVGTIKSKVVGDRENGSDNLPSSAGSGDKPLSDPAPF

SEQ ID NO: 1171 - protein, 200 aa, Homo sapiens
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYKKTQETLSQAGQKTSAALSTVGSAISRKLGDMSSYSIRHSISMPAMRNSATFKSFEDRVGTIKSKVVGDRENGSDNLPSSAGSGDKPLSDPAPF

SEQ ID NO: 1172 - protein, 548 aa, Homo sapiens
MAAPPARADADPSPTSPPTARDTPGRQAEKSETACEDRSNAESLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAINLIVQHVHSQLEERELSVRAALASAHQCHPLPRTLSVLKSTPQVRGMHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPELHYLRLPKDISDDHVILMDCTVSTGAAAMMAVRVLLDHDVPEDKIFLLSLLMAEMGVHSVAYAFPRVRIITTAVDKRVNDLFRIIPGIGNFGDRYFGTDAVPDGSDEEEVAYTG

SEQ ID NO: 1173 - protein, 941 aa, Homo sapiens
MNKKKKPFLGMPAPLGYVPGLGRGATGFTTRSDIGPARDANDPVDDRHAPPGKRTVGDQMKKNQAADDDDEDLNDTNYDEFNGYAGSLFSSGPYEKDDEEADAIYAALDKRMDERRKERREQREKEEIEKYRMERPKIQQQFSDLKRKLAEVTEEEWLSIPEVGDARNKRQRNPRYEKLTPVPDSFFAKHLQTGENHTSVDPRQTQFGGLNTPYPGGLNTPYPGGMTPGLMTPGTGELDMRKIGQARNTLMDMRLSQVSDSVSGQTVVDPKGYLTDLNSMIPTHGGDINDIKKARLLLKSVRETNPHHPPAWIASARLEEVTGKLQVARNLIMKGTEMCPKSEDVWLEAARLQPGDTAKAVVAQAVRHLPQSVRIYIRAAELETDIRAKKRVLRKALEHVPNSVRLWKAAVELEEPEDARIMLSRAVECCPTSVELWLALARLETYENARKVLNKARENIPTDRHIWITAAKLEEANGNTQMVEKIIDRAITSLRANGVEINREQWIQDAEECDRAGSVATCQAVMRAVIGIGIEEEDRKHTWMEDADSCVAHNALECARAIYAYALQVFPSKKSVWLRAAYFEKNHGTRESLEALLQRAVAHCPKAEVLWLMGAKSKWLAGDVPAARSILALAFQANPNSEEIWLAAVKLESENDEYERARRLLAKARSSAPTARVFMKSVKLEWVQDNIRAAQDLCEEALRHYEDFPKLWMMKGQIEEQKEMMEKAREAYNQGLKKCPHSTPLWLLLSRLEEKIGQLTRARAILEKSRLKNPKNPGLWLESVRLEYRAGLKNIANTLMAKALQECPNSGILWSEAIFLEARPQRRTKSVDALKKCEHDPHVLLAVAKLFWSQRKITKAREWFHRTVKIDSDLGDAWAFFYKFELQHGTEEQQEEVRKRCESAEPRHGELWCAVSKDIANWQKKIGDILRLVAGRIKNTF

SEQ ID NO: 1174 - protein, 118 aa, Homo sapiens
MPFLELDTNLPANRVPAGLEKRLCAAAASILGKPADRVNVTVRPGLAMALSGSTEPCAQLSISSIGVVGTAEDNRSHSAHFFEFLTKELALGQDRILIRFFPLESWQIGKIGTVMTFL

SEQ ID NO: 1175 - protein, 240 aa, Homo sapiens
MGLELYLDLLSQPCRAVYIFAKKNDIPFELRIVDLIKGQHLSDAFAQVNPLKKVPALKDGDFTLTESVAILLYLTRKYKVPDYWYPQDLQARARVDEYLAWQHTTLRRSCLRALWHKVMFPVFLGGPVSPQTLAATLAELDVTLQLLEDKFLQNKAFLTGPHISLADLVAITELMHPVGAGCQVFEGRPKLATWRQRVEAAVGEDLFQEAHEVILKAKDFPPADPTIKQKLMPWVLAMIR

SEQ ID NO: 1176 - protein, 135 aa, Homo sapiens
MDSRFPDFQDLDLEPERACHDAAGTLEVDFFLFLNFGTVDLAVRKETTTEQALPPALLLGIRRPEFLSRPSVQTEDAPSKVNYVLCLLIAECSPGPSDYLPCAIPSAYRPGTWIFARDDSYHLTTDEDTHSSGPL

SEQ ID NO: 1177 - protein, 135 aa, Homo sapiens; identical to SEQ ID NO: 1176

SEQ ID NO: 1178 - protein, 524 aa, Homo sapiens
MISPFLVLAIGTCLTNSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSPVPLRHETHGGEDVAVFSKGPMAHLLHGVHEQNYVPHVMAYAACIGANLGHCAPASSAGSLAAGPLLLALALYPLSVLF

SEQ ID NO: 1179 - protein, 730 aa, Homo sapiens
MDESLANLSEDEYYSEEERNAKAEKEKKLPPPPPQAPPEEENESEPEEPSGVEGAAFQSRLPHDRMTSQEAACFPDIISGPQQTQKVFLFIRNRTLQLWLDNPKIQLTFEATLQQLEAPYNSDTVLVHRVHSYLERHGLINFGIYKRIKPLPTKKTGKVIIIGSGVSGLAAARQLQSFGMDVTLLEARDRVGGRVATFRKGNYVADLGAMVVTGLGGNPMAVVSKQVNMELAKIKQKCPLYEANGQAVPKEKDEMVEQEFNRLLEATSYLSHQLDFNVLNNKHVSLGQALEVVIQLQEKHVKDEQIEHWKKIVKTQEELKELLNKMVNLKEKIKELHQQYKEASEVKPPRDITAEFLVKSKHRDLTALCKEYDELAETQGKLEEKLQELEANPPSDVYLSSRDRQILDWHFANLEFANATPLSTLSLKHWDQDDDFEFTGSHLTVRNGYSCVPVALAEGLDIKLNTAVRQVRYTASGCEVIAVNTRSTSQTFIYKCDAVLCTLPLGVLKQQPPAVQFVPPLPEWKTSAVQRMGFGNLNKVVLCFDRVFWDPSVNLFGHVGSTTASRGELFLFWNLYKAPILLALVAGEAAGIMENISDDVIVGRCLAILKGIFGSSAVPQPKETVVSRWRADPWARGSYSYVAAGSSGNDYDLMAQPITPGPSIPGAPQPIPRLFFAGEHTIRNYPATVHGALLSGLREAGRIADQFLGAMYTLPRQATPGVPAQQSPSM

SEQ ID NO: 1180 - protein, 437 aa, Homo sapiens
MLQGPRALASAAGQTPKVVPAMSPTELWPSGLSSPQLCPATATYYTPLYPQTAPPAAAPGTCLDATPHGPEGQVVRCLPAGRLPAKRKLDLEGIGRPVVPEFPTPKGKCIRVDGLPSPKTPKSPGEKTRYDTSLGLLTKKFIYLLSESEDGVLDLNWAAEVLDVQKRRIYDITNVLEGIQLIRKKAKNNIQWVGRGMFEDPTRPGKQQQLGQELKELMNTEQALDQLIQSCSLSFKHLTEDKANKRLAYVTYQDIRAVGNFKEQTVIAVKAPPQTRLEVPDRTEDNLQIYLKSTQGPIEVYLCPEEVQEPDSPSEEPLPSTSTLCPSPDSAQPSSSTDPSIMEPTASSVPAPAPTPQQAPPPPSLVPLEATDSLLELPHPLLQQTEDQFLSPTLACSSPLISFSPSLDQDDYLWGLEAGEGISDLFDSYDLGDLLIN

SEQ ID NO: 1181 - protein, 231 aa, Homo sapiens
MCGNTMSVPLLTDAATVSGAERETAAVIFLHGLGDTGHSWADALSTIRLPHVKYICPHAPRIPVTLNMKMVMPSWFDLMGLSPDAPEDEAGIKKAAENIKALIEHEMKNGIPANRIVLGGFSQGGALSLYTALTCPHPLAGIVALSCWLPLHRAFPQAANGSAKDLAILQCHGELDPMVPVRFGALTAEKLRSVVTPARVQFKTYPGVMHSSCPQEMAAVKEFLEKLLPPV

SEQ ID NO: 1182 - protein, 348 aa, Homo sapiens
MAEKVLVTGGAGYIGSHTVLELLEAGYLPVVIDNFHNAFRGGGSLPESLRRVQELTGRSVEFEEMDILDQGALQRLFKKYSFMAVIHFAGLKAVGESVQKPLDYYRVNLTGTIQLLEIMKAHGVKNLVFSSSATVYGNPQYLPLDEAHPTGGCTNPYGKSKFFIEEMIRDLCQADKTWNVVLLRYFNPTGAHASGCIGEDPQGIPNNLMPYVSQVAIGRREALNVFGNDYDTEDGTGVRDYIHVVDLAKGHIAALRKLKEQCGCRIYNLGTGTGYSVLQMVQAMEKASGKKIPYKVVARREGDVAACYANPSLAQEELGWTAALGLDRMCEDLWRWQKQNPSGFGTQA

SEQ ID NO: 1183 - protein, 325 aa, Homo sapiens
MAAMRKALPRRLVGLASLRAVSTSSMGTLPKRVKIVEVGPRDGLQNEKNIVSTPVKIKLIDMLSEAGLSVIETTSFVSPKWVPQMGDHTEVLKGIQKFPGINYPVLTPNLKGFEAAVAAGAKEVVIFGAASELFTKKNINCSIEESFQRFDAILKAAQSANISVRGYVSCALGCPYEGKISPAKVAEVTKKFYSMGCYEISLGDTIGVGTPGIMKDMLSAVMQEVPLAALAVHCHDTYGQALTNTLMALQMGVSVVDSSVAGLGGCPYAQGASGNLATEDLVYMLEGLGIHTGVNLQKLLEAGNFICQALNRKTSSKVAQATCKL

SEQ ID NO: 1184 - protein, 231 aa, Homo sapiens; identical to SEQ ID NO: 1181

SEQ ID NO: 1185 - protein, 461 aa, Homo sapiens
MRSRPAGPALLLLLLFLGAAESVRRAQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTALRKRNIRYGLYHSLLEWFHPLYLLDKKNGFKTQHFVSAKTMPELYDLVNSYKPDLIWSDGEWECPDTYWNSTNFLSWLYNDSPVKDEVVVNDRWGQNSSCHHGGYYNCEDKFKPQSLPDHKWEMCTSIDKFSWGYRRDMALSDVTEESEIISELVQTVSLGGNYLLNIGPTKDGLIVPIFQERLLAVGKWLSINGEAIYASKPWRVQWEKNTTSVWYTSKGSAVYAIFLHWPENGVLNLESPITTSTTKITMLGIQGDLKWSTDPDKGLFISLPQLPPSAVPAEFAWTIKLTGVK

SEQ ID NO: 1186 - protein, 904 aa, Homo sapiens
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 1187 - protein, 253 aa, Homo sapiens
MALSMPLNGLKEEDKEPLIELFVKAGSDGESIGNCPFSQRLFMILWLKGVVFSVTTVDLKRKPADLQNLAPGTHPPFITFNSEVKTDVNKIEEFLEEVLCPPKYLKLSPKHPESNTAGMDIFAKFSAYIKNSRPEANEALERGLLKTLQKLDEYLNSPLPDEIDENSMEDIKFSTRKFLDGNEMTLADCNLLPKLHIVKVVAKKYRNFDIPKEMTGIWRYLTNAYSRDEFTNTCPSDKEVEIAYSDVAKRLTK

SEQ ID NO: 1188 - protein, 290 aa, Homo sapiens
MSNYVNDMWPGSPQEKDSPSTSRSGGSSRLSSRSRSRSFSRSSRSHSRVSSRFSSRSRRSKSRSRSRRRHQRKYRRYSRSYSRSRSRSRSRRYRERRYGFTRRYYRSPSRYRSRSRSRSRSRGRSYCGRAYAIARGQRYYGFGRTVYPEEHSRWRDRSRTRSRSRTPFRLSEKDRMELLEIAKTNAAKALGTTNIDLPASLRTVPSAKETSRGIGVSSNGAKPELSEKVTEDGTRNPNEKPTQQRSIAFSSNNSVAKPIQKSAKAATEEASSRSPKIDQKKSPYGLWIPI

SEQ ID NO: 1189 - protein, 149 aa, Homo sapiens
MASSDIQVKELEKRASGQAFELILSPRSKESVPEFPLSPPKKKDLSLEEIQKKLEAAEERRKSHEAEVLKQLAEKREHEKEVLQKAIEENNNFSKMAEEKLTHKMEANKENREAQMAAKLERLREKDKHIEEVRKNKESKDPADETEAD

SEQ ID NO: 1190 - protein, 116 aa, Homo sapiens
MKAKRRRPDLDEIHRELRPQGSARPQPDPNAEFDPDLPGGGLHRCLACARYFIDSTNLKTHFRSKDHKKRLKQLSVEPYSQEEAERAAGMGSYVPPRRLAVPTEVSTEVPEMDTST

SEQ ID NO: 1191 - protein, 90 aa, Homo sapiens
MPKRKAEGDAKGDKAKVKDEPQRRSARLSAKPAPPKPEPKPKKAPAKKGEKVPKGKKGKADAGKEGNNPAENGDAKTDQAQKAEGAGDAK

SEQ ID NO: 1192 - protein, 735 aa, Homo sapiens
MPLAQLKEPWPLMELVPLDPENGQTSGEEAGLQPSKDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 1193 - protein, 493 aa, Homo sapiens
MWPQDPSRKEVLRFAVSCRILTLMLQALFNAIIPDHHAEAFSPPRLAPSGFVDQLVEGLLGGLSHWDAEHFLFIAEHGYLYEHNFAFFPGFPLALLVGTELLRPLRGLLSLRSCLLISVASLNFLFFMLAAVALHDLGCLVLHCPHQSFYAALLFCLSPANVFLAAGYSEALFALLTFSAMGQLERGRVWTSVLLFAFATGVRSNGLVSVGFLMHSQCQGFFSSLTMLNPLRQLFKLMASLFLSVFTLGLPFALFQYYAYTQFCLPGSARPIPEPLVQLAVDKGYRIAEGNEPPWCFWDVPLIYSYIQDVYWNVGFLKYYELKQVPNFLLAAPVAILVAWATWTYVTTHPWLCLTLGLQRSKNNKTLEKPDLGFLSPQVFVYVVHAAVLLLFGGLCMHVQVLTRFLGSSTPIMYWFPAHLLQDQEPLLRSLKTVPWKPLAEDSPPGQKVPRNPIMGLLYHWKTCSPVTRYILGYFLTYWLLGLLLHCNFLPWT

SEQ ID NO: 1194 - protein, 493 aa, Homo sapiens; identical to SEQ ID NO: 1193

SEQ ID NO: 1195 - protein, 525 aa, Homo sapiens
MAVPGEAEEEATVYLVVSGIPSVLRSAHLRSYFSQFREERGGGFLCFHYRHRPERAPPQAAPNSALIPTDPAAEGQLLSQTSATDVRPLSTRDSTPIQTRTCCCVISVRGLAQAQRLIRMYSGRRWLDSHGTWLPGRCLIRRLRLPTEASGLGPFPFKTRKELQSWKAENEAFTLADLKQLPELNPPVLMPRGNVGTPLRVFLELIRACRLPPRIITQLQLQFPKTGSSRRYGNVPFEYEDSETVEQEELVCTAEGEEIPQGTYLADIPASPCGEPEEEVGKEEEEESHSDEDDDRGEEWERHEALHEDVTGQERTTEQLFEEEIELKWEKGGSGLVFYTDAQFWQEEEGDFDEQTADDWDVDMSVYYDRDGGDKDARDSVQMRLEQRLRDGQEDGSVIERQVGTFERHTKGIGRKVMERQGWAEGQGLGCRCSGVPEALDSDGQHPRCKRGLGYHGEKLQPFGQLKRPRRNGLGLISTIYDEPLPQDQTESLLRRQPPTSMKFRTDMAFVRGSSCASDSPSLPD

SEQ ID NO: 1196 - protein, 331 aa, Homo sapiens
MGGEQEEERFDGMLLAMAQQHEGGVQELVNTFFSFLRRKTDFFIGGEEGMAEKLITQTFSHHNQLAQKTRREKRARQEAERREKAERAARLAKEAKSETSGPQIKELTDEEAERLQLEIDQKKDAENHEAQLKNGSLDSPGKQDTEEDEEEDEKDKGKLKPNLGNGADLPNYRWTQTLSELDLAVPFCVNFRLKGKDMVVDIQRRHLRVGLKGQPAIIDGELYNEVKVEESSWLIEDGKVVTVHLEKINKMEWWSRLVSSDPEINTKKINPENSKLSDLDSETRSMVEKMMYDQRQKSMGLPTSDEQKKQEILKKFMDQHPEMDFSKAKFN

SEQ ID NO: 1197 - protein, 287 aa, Homo sapiens
MAASLWMGDLEPYMDENFISRAFATMGETVMSVKIIRNRLTGIPAGYCFVEFADLATAEKCLHKINGKPLPGATPAKRFKLNYATYGKQPDNSPEYSLFVGDLTPDVDDGMLYEFFVKVYPSCRGGKVVLDQTGVSKGYGFVKFTDELEQKRALTECQGAVGLGSKPVRLSVAIPKASRVKPVEYSQMYSYSYNQYYQQYQNYYAQWGYDQNTGSYSYSYPQYGYTQSTMQTYEEVGDDALEDPMPQLDVTEANKEFMEQSEELYDALMDCHWQPLDTVSSEIPAMM

SEQ ID NO: 1198 - protein, 161 aa, Homo sapiens
MNQFGPSALINLSNFSSIKPEPASTPPQGSMANSTAVVKIPGTPGAGGRLSPENNQVLTKKKLQDLVREVDPNEQLDEDVEEMLLQIADDFIESVVTAACQLARHRKSSTLEVKDVQLHLERQWNMWIPGFGSEEIRPYKKACTTEAHKQRMALIRKTTKK

SEQ ID NO: 1199 - protein, 573 aa, Homo sapiens
MANAEVSVPVGDVVVVPTEGNEGENPEDTKTQVILQLQPVQQGLFIDGHFYNRIYEAGSENNTAVVAVETHTIHKIEEGIDTGTIEANEDMEIAYPITCGESKAILLWKKFVCPGINVKCVKFNDQLISPKHFVHLAGKSTLKDWKRAIRLGGIMLRKMMDSGQIDFYQHDKVCSNTCRSTKFDLLISSARAPVPGQQTSVVQTPTSADGSITQIAISEESMEEAGLEWNSALTAAVTMATEEGVKKDSEEISEDTLMFWKGIADVGLMEEVVCNIQKEIEELLRGVQQRLIQAPFQVTDAAVLNNVAHTFGLMDTVKKVLDNRRNQVEQGEEQFLYTLTDLERQLEEQKKQGQDHRLKSQTVQNVVLMPVSTPKPPKRPRLQRPASTTVLSPSPPVQQPQFTVISPITITPVGQSFSMGNIPVATLSQGSSPVTVHTLPSGPQLFRYATVVSSAKSSSPDTVTIHPSSSLALLSSTAMQDGSTLGNMTTMVSPVELVAMESGLTSAIQAVESTSEDGQTIIEIDPAPDPEAEDTEGKAVILETELRTEEKVVAEMEEHQHQVHNVEIVVLED

SEQ ID NO: 1200 - protein, 563 aa, Homo sapiens
MANAEVSVPVGDVVVVPTEGNEGENPEDTKTQVILQLQPVQQGIYEAGSENNTAVVAVETHTIHKIEEGIDTGTIEANEDMEIAYPITCGESKAILLWKKFVCPGINVKCVKFNDQLISPKHFVHLAGKSTLKDWKRAIRLGGIMLRKMMDSGQIDFYQHDKVCSNTCRSTKFDLLISSARAPVPGQQTSVVQTPTSADGSITQIAISEESMEEAGLEWNSALTAAVTMATEEGVKKDSEEISEDTLMFWKGIADVGLMEEVVCNIQKEIEELLRGVQQRLIQAPFQVTDAAVLNNVAHTFGLMDTVKKVLDNRRNQVEQGEEQFLYTLTDLERQLEEQKKQGQDHRLKSQTVQNVVLMPVSTPKPPKRPRLQRPASTTVLSPSPPVQQPQFTVISPITITPVGQSFSMGNIPVATLSQGSSPVTVHTLPSGPQLFRYATVVSSAKSSSPDTVTIHPSSSLALLSSTAMQDGSTLGNMTTMVSPVELVAMESGLTSAIQAVESTSEDGQTIIEIDPAPDPEAEDTEGKAVILETELRTEEKVVAEMEEHQHQVHNVEIVVLED

SEQ ID NO: 1201 - protein, 570 aa, Homo sapiens
MSASSLLEQRPKGQGNKVQNGSVHQKDGLNDDDFEPYLSPQARPNNAYTAMSDSYLPSYYSPSIGFSYSLGEAAWSTGGDTAMPYLTSYGQLSNGEPHFLPDAMFGQPGALGSTPFLGQHGFNFFPSGIDFSAWGNNSSQGQSTQSSGYSSNYAYAPSSLGGAMIDGQSAFANETLNKAPGMNTIDQGMAALKLGSTEVASNVPKVVGSAVGSGSITSNIVASNSLPPATIAPPKPASWADIASKPAKQQPKLKTKNGIAGSSLPPPPIKHNMDIGTWDNKGPVAKAPSQALVQNIGQPTQGSPQPVGQQANNSPPVAQASVGQQTQPLPPPPPQPAQLSVQQQAAQPTRWVAPRNRGSGFGHNGVDGNGVGQSQAGSGSTPSEPHPVLEKLRSINNYNPKDFDWNLKHGRVFIIKSYSEDDIHRSIKYNIWCSTEHGNKRLDAAYRSMNGKGPVYLLFSVNGSGHFCGVAEMKSAVDYNTCAGVWSQDKWKGRFDVRWIFVKDVPNSQLRHIRLENNENKPVTNSRDTQEVPLEKAKQVLKIIASYKHTTSIFDDFSHYEKRQRGRRKC

SEQ ID NO: 1202 - protein, 494 aa, Homo sapiens
MPRVYIGRLSYQARERDVERFFKGYGKILEVDLKNGYGFVEFDDLRDADDAVYELNGKDLCGERVIVEHARGPRRDGSYGSGRSGYGYRRSGRDKYGPPTRTEYRLIVENLSSRCSWQDLKDYMRQAGEVTYADAHKGRKNEGVIEFVSYSDMKRALEKLDGTEVNGRKIRLVEDKPGSRRRRSYSRSRSHSRSRSRSRHSRKSRSRSGSSKSSHSKSRSRSRSGSRSRSKSRSRSQSRSRSKKEKSRSPSKEKSRSRSHSAGKSRSKSKDQAEEKIQNNDNVGKPKSRSPSRHKSKSKSRSRSQERRVEEEKRGSVSRGRSQEKSLRQSRSRSRSKGGSRSRSRSRSKSKDKRKGRKRSREESRSRSRSRSKSERSRKRGSKRDSKAGSSKKKKKEDTDRSQSRSPSRSVSKEREHAKSESSQREGRGESENAGTNQETRSRSRSNSKSKPNLPSESRSRSKSASKTRSRSKSRSRSASRSPSRSRSRSHSRS

SEQ ID NO: 1203 - protein, 373 aa, Homo sapiens
MWVCSTLWRVRTPPGSGGGLLPASGCHGPAASSYSASAEPARVRGVVYGHHGDPAKVVELKNLELAAVRGSDVRVKMLAAPINPSDINMIQGNYGLLPELPAVGGNEGVAQVVAVGSNVTGLKPGDWVIPANAGLGTWRTEAVFSEEALIQVPSDIPLQSAATLGVNPCTAYRMLMDFEQLQPGDSVIQNASNSGVGQAVIQIAAALGLRTINVVRDRPDIQKLSDRLKSLGAEHVITEEELRRPEMKNFFKDMPQPRLALNCVGGKSSTELLRQLARGGTMVTYGGMAKQPVVASVSLLIFKDLKLRGFWLSQWKKDHSPDQFKELILTLCDLIRRGQLTAPACSQVPLQDYQSALEASMKPFISSKQILTM

SEQ ID NO: 1204 - protein, 163 aa, Homo sapiens
MAVILGIFGTVQYRSRYLILYAAWLVLWVGWNAFIICFYLEVGQLSQDRDFIMTFNTSLHRSWWMENGPGCLVTPVLNSRLALEDHHVISVTGCLLDYPYIEALSSALQIFLALFGFVFACYVSKVFLEEEDSFDFIGGFDSYGYQAPQKTSHLQLQPLYTSG

SEQ ID NO: 1205 - protein, 1046 aa, Homo sapiens
MGNSHHKRKAPSGPRVRSFWRFGRSAKRPAGSAKAENDKHLSVGPGQGPGSAVDEHQDNVFFPSGRPPHLEELHTQAQEGLRSLQHQEKQKLNKGGWDHGDTQSIQSSRTGPDEDNISFCSQTTSYVAESSTAEDALSIRSEMIQRKGSTFRPHDSFPKSGKSGRRRRERRSTVLGLPQHVQKELGLRNEREAPGTPRAPGARDAVRIPTVDGRPRGTSGMGARVSLQALEAEAEAGAETEAMLQRHIDRVYRDDTFVGRSTGTRAPPLTRPMSLAVPGLTGGAGPAEPLSPAMSISPQATYLSKLIPHAVLPPTVDVVALGRCSLRTLSRCSLHSASPASVRSLGRFSSVSSPQPRSRHPSSSSDTWSHSQSSDTIVSDGSTLSSKGGSEGQPESSTASNSVVPPPQGGSGRGSPSGGSTAEASDTLSIRSSGQLSGRSVSLRKLKRPPPPPRRTHSLHQRGLAVPDGPLGLPPKPERKQQPQLPRPPTTGGSEGAGAAPCPPNPANSWVPGLSPGGSRRPPRSPERTLSPSSGYSSQSGTPTLPPKGLAGPPASPGKAQPPKPERVTSLRSPGASVSSSLTSLCSSSSDPAPSDRSGPQILTPLGDRFVIPPHPKVPAPFSPPPSKPRSPNPAAPALAAPAVVPGPVSTTDASPQSPPTPQTTLTPLQESPVISKDQSPPPSPPPSYHPPPPPTKKPEVVVEAPSASETAEEPLQDPNWPPPPPPAPEEQDLSMADFPPPEEAFFSVASPEPAGPSGSPELVSSPAASSSSATALQIQPPGSPDPPPAPPAPAPASSAPGHVAKLPQKEPVGCSKGGGPPREDVGAPLVTPSLLQMVRLRSVGAPGGAPTPALGPSAPQKPLRRALSGRASPVPAPSSGLHAAVRLKACSLAASEGLSSAQPNGPPEAEPRPPQSPASTASFIFSKGSRKLQLERPVSPETQADLQRNLVAELRSISEQRPPQAPKKSPKAPPPVARKPSVGVPPPASPSYPRAEPLTAPPTNGLPHTQDRTKRELAENGGVLQLVGPEEKMGLPGSDSQKELA

SEQ ID NO: 1206 - protein, 541 aa, Homo sapiens
MLRRYLASDPDCRWCPAPDCGYAVIAYGCASCPKLTCEREGCQTEFCYHCKQIWHPNQTCDMARQQRAQTLRVRTKHTSGLSYGQESGPADDVKPCPRCSAYIIKMNDGSCNHMTCAVCGCEFCWLCMKEISDLHYLSPSGCTFWGKKPWSRKKKILWQLGTLIGAPVGISLIAGIAIPAMVIGIPVYVGRKIHSRYEGRKTSKHKRNLAITGGVTLSVIASPVIAAVSVGIGVPIMLAYVYGVVPISLCRGGGCGVSTANGKGVKIEFDEDDGPITVADAWRALKNPSIGESSIEGLTSVLSTSGSPTDGLSVMQGPYSETASFAALSGGTLSGGILSSGKGKYSRLEVQADVQKEIFPKDTASLGAISDNASTRAMAGSIISSYNPQDRECNNMEIQVDIEAKPSHYQLVSGSSTEDSLHVHAQMAENEEEGSGGGGSEEDPPCRHQSCEQKDCLASKPWDISLAQPESIRSDLESSDAQSDDVPDITSDECGSPRSHTAACPSTPRAQGAPSPSAHMNLSALAEGQTVLKPEGGEARV

SEQ ID NO: 1207 - protein, 323 aa, Homo sapiens
MTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 1208 - protein, 858 aa, Homo sapiens
MENELPVPHTSSSACATSSTSGASSSSGCNNSSSGGSGRPTGPQISVYSGIPDRQTVQVIQQALHRQPSTAAQYLQQMYAAQQQHLMLQTAALQQQHLSSAQLQSLAAVQQASLVSNRQGSTSGSNVSAQAPAQSSSINLAASPAAAQLLNRAQSVNSAAASGIAQQAVLLGNTSSPALTASQAQMYLRAQMLIFTPTATVATVQPELGTGSPARPPTPAQVQNLTLRTQQTPAAAASGPTPTQPVLPSLALKPTPGGSQPLPTPAQSRNTAQASPAGAKPGIADSVMEPHKKGDGNSSVPGSMEGRAGLSRTVPAVAAHPLIAPAYAQLQPHQLLPQPSSKHLQPQFVIQQQPQPQQQQPPPQQSRPVLQAEPHPQLASVSPSVALQPSSEAHAMPLGPVTPALPLQCPTANLHKPGGSQQCHPPTPDTGPQNGHPEGVPHTPQRRFQHTSAVILQLQPASPPQQCVPDDWKEVAPGEKSVPETRSGPSPHQQAIVTAMPGGLPVPTSPNIQPSPAHETGQGIVHALTDLSSPGMTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 1209 - protein, 202 aa, Homo sapiens
MEAALLGLCNWSTLGVCAALKLPQISAVLAARSARGLSLPSLLLELAGFLVFLRYQCYYGYPPLTYLEYPILIAQDVILLLCIFHFNGNVKQATPYIAVLVSSWFILALQKWIIDLAMNLCTFISAASKFAQLQCLWKTRDSGTVSALTWSLSSYTCATRIITTLMTTNDFTILLRFVIMLALNIWVTVTVLRYRKTAIKAE

SEQ ID NO: 1210 - protein, 400 aa, Homo sapiens
MAANYSSTSTRREHVKVKTSSQPGFLERLSETSGGMFVGLMAFLLSFYLIFTNEGRALKTATSLAEGLSLVVSPDSIHSVAPENEGRLVHIIGALRTSKLLSDPNYGVHLPAVKLRRHVEMYQWVETEESREYTEDGQVKKETRYSYNTEWRSEIINSKNFDREIGHKNPSAMAVESFMATAPFVQIGRFFLSSGLIDKVDNFKSLSLSKLEDPHVDIIRRGDFFYHSENPKYPEVGDLRVSFSYAGLSGDDPDLGPAHVVTVIARQRGDQLVPFSTKSGDTLLLLHHGDFSAEEVFHRELRSNSMKTWGLRAAGWMAMFMGLNLMTRILYTLVDWFPVFRDLVNIGLKAFAFCVATSLTLLTVAAGWLFYRPLWALLIAGLALVPILVARTRVPAKKLE

SEQ ID NO: 1211 - protein, 940 aa, Homo sapiens
MARKRAAGGEPRGRELRSQKSKAKSKARREEEEEDAFEDEKPPKKSLLSKVSQGKRKRGCSHPGGSADGPAKKKVAKVTVKSENLKVIKDEALSDGDDLRDFPSDLKKAHHLKRGATMNEDSNEEEEESENDWEEVEELSEPVLGDVRESTAFSRSLLPVKPVEIEIETPEQAKTRERSEKIKLEFETYLRRAMKRFNKGVHEDTHKVHLLCLLANGFYRNNICSQPDLHAIGLSIIPARFTRVLPRDVDTYYLSNLVKWFIGTFTVNAELSASEQDNLQTTLERRFAIYSARDDEELVHIFLLILRALQLLTRLVLSLQPIPLKSATAKGKKPSKERLTADPGGSSETSSQVLENHTKPKTSKGTKQEETFAKGTCRPSAKGKRNKGGRKKRSKPSSSEEDEGPGDKQEKATQRRPHGRERRVASRVSYKEESGSDEAGSGSDFELSSGEASDPSDEDSEPGPPKQRKAPAPQRTKAGSKSASRTHRGSHRKDPSLPAASSSSSSSKRGKKMCSDGEKAEKRSIAGIDQWLEVFCEQEEKWVCVDCVHGVVGQPLTCYKYATKPMTYVVGIDSDGWVRDVTQRYDPVWMTVTRKCRVDAEWWAETLRPYQSPFMDREKKEDLEFQAKHMDQPLPTAIGLYKNHPLYALKRHLLKYEAIYPETAAILGYCRGEAVYSRDCVHTLHSRDTWLKKARVVRLGEVPYKMVKGFSNRARKARLAEPQLREENDLGLFGYWQTEEYQPPVAVDGKVPRNEFGNVYLFLPSMMPIGCVQLNLPNLHRVARKLDIDCVQAITGFDFHGGYSHPVTDGYIVCEEFKDVLLTAWENEQAVIERKEKEKKEKRALGNWKLLAKGLLIRERLKRRYGPKSEAAAPHTDAGGGLSSDEEEGTSSQAEAARILAASWPQNREDEEKQKLKGGPKKTKREKKAAASHLFPFEKL

SEQ ID NO: 1212 - protein, 102 aa, Homo sapiens
MADDVDQQQTTNTVEEPLDLIRLSLDERIYVKMRNDRELRGRLHAYDQHLNMILGDVEETVTTIEIDEETYEEIYKSTKRNIPMLFVRGDGVVLVAPPLRVG

SEQ ID NO: 1213 - protein, 557 aa, Homo sapiens
MAAPMLRWGCRGRRWAFARVDGGSCHRRGAPTGSTSNQIRGESSVAQQPLHTAQKTRKGEHKWAAVVGLEIHAQISSNSKLFSGSQVRFSAPPNSLVSFFDASLPGTLPVLNRRCVEAAVMTGLALNCHINKKSLFDRKHYFYADLPAGYQITQQRLPIAVNGSLIYGVCAGKKQSQVIPKTVRIKQIQLEQDSGKSLHDNLRSQTLIDLNRAGVGLLEVVLEPDMSCGEEAATAVRELQLILQALGTSQANMAEGQLRVDANISVHHPGEPLGVRTEVKNLNSIRFLAKAIDYEIQRQINELENGGEILNETRSFHHKLGCTMSMRDKEGKQDYRFMPEPNLPPLVLYDATSLPAGADPQQVINIDQIRETLPELPSVTREKLVQQYGMLLEHSFTLLNEVGLLEFFQNVIKETRAEPKKVTSWVLNTFLGYLKQQNLAVSESPVTPSALAELLDLLDSRTISSSAAKQVFEELWKREGKTPGQIVSEKQLELMQDQGALEQLCHSVMEAHPQVVMDVKNRNPRAINKLIGLVRKATQSRADPVMIKEILEKKLSL

SEQ ID NO: 1214 - protein, 627 aa, Homo sapiens
MCVPRSGLILSCICLYCGVLLPVLLPNLPFLTCLSMSTLESVTYLPEKGLYCQRLPSSRTHGGTESLKGKNTENMGFYGTLKMIFYKMKRKLDHGSEVRSFSLGKKPCKVSEYTSTTGLVPCSATPTTFGDLRAANGQGQQRRRITSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKCLRTLVGHTGGVWSSQMRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 1215 - protein, 707 aa, Homo sapiens
MNQELLSVGSKRRRTGGSLRGNPSSSQVDEEQMNRVVEEEQQQQLRQQEEEHTARNGEVVGVEPRPGGQNDSQQGQLEENNNRFISVDEDSSGNQEEQEEDEEHAGEQDEEDEEEEEMDQESDDFDQSDDSSREDEHTHTNSVTNSSSIVDLPVHQLSSPFYTKTTKMKRKLDHGSEVRSFSLGKKPCKVSEYTSTTGLVPCSATPTTFGDLRAANGQGQQRRRITSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKCLRTLVGHTGGVWSSQMRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 1216 - protein, 657 aa, Homo sapiens
MRLKIGFILRSLLVVGSFLGLVVLWSSLTPRPDDPSPLSRMREDRDVNDPMPNRGGNGLAPGEDRFKPVVPWPHVEGVEVDLESIRRINKAKNEQEHHAGGDSQKDIMQRQYLTFKPQTFTYHDPVLRPGILGNFEPKEPEPPGVVGGPGEKAKPLVLGPEFKQAIQASIKEFGFNMVASDMISLDRNVNDLRQEECKYWHYDENLLTSSVVIVFHNEGWSTLMRTVHSVIKRTPRKYLAEIVLIDDFSNKEHLKEKLDEYIKLWNGLVKVFRNERREGLIQARSIGAQKAKLGQVLIYLDAHCEVAVNWYAPLVAPISKDRTICTVPLIDVINGNTYEIIPQGGGDEDGYARGAWDWSMLWKRVPLTPQEKRLRKTKTEPYRSPAMAGGLCAIEREFFFELGLYDPSLQIWGGENFEISYKIWQCGGKLLFVPCSRVGHIYRLEGWQGNPPPIYVGSSPTLKNYVRVVEVWWDEYKDYFYASRPESQALPYGDISELKKFREDHNCQSFKWFMEEIAYDITSHYPLPPKNVDWGEIRGFETAYCIDSMGKTNGGFVELGPCHRMGGNQLFRINEANQLMQYDQCLTKGADGSKVMITHCNLNEFKEWQYFKNLHRFTHIPSGKCLDRSEVLHQVFISNCDSSKTTQKWEMNNIHSV

SEQ ID NO: 1217 - protein, 217 aa, Homo sapiens
MSLVGGFPHHPVVHHEGYPFAAAAAAAAAAAASRCSHEENPYFHGWLIGHPEMSPPDYSMALSYSPEYASGAAGLDHSHYGGVPPGAGPPGLGGPRPVKRRGTANRKERRRTQSINSAFAELRECIPNVPADTKLSKIKTLRLATSYIAYLMDLLAKDDQNGEAEAFKAEIKKTDVKEEKRKKELNEILKSTVSSNDKKTKGRTGWPQHVWALELKQ

SEQ ID NO: 1218 - protein, 178 aa, Homo sapiens
MSEVSCKKRDDYLEWPEYFMAVAFLSAQRSKDPNSQVGACIVNSENKIVGIGYNGMPNGCSDDVLPWRRTAENKLDTKYPYVCHAELNAIMNKNSTDVKGCSMYVALFPCNECAKLIIQAGIKEVIFTSDKYHDSDEATAARLLFNMAGVTFRKFIPKCSKIVIDFDSINSRPSQKLQ

SEQ ID NO: 1219 - protein, 580 aa, Homo sapiens
MAQEVSEYLSQNPRVAAWVEALRCDGETDKHWRHRRDFLLRNAGDLAPAGGAASASTDEAADAESGTRNRQLQQLISFSMAWANHVFLGCRYPQKVMDKILSMAEGIKVTDAPTYTTRDELVAKVKKRGISSSNEGVEEPSKKRVIEGKNSSAVEQDHAKTSAKTERASAQQENSSTCIGSAIKSESGNSARSSGISSQNSSTSDGDRSVSSQSSSSVSSQVTTAGSGKASEAEAPDKHGSASFVSLLKSSVNSHMTQSTDSRQQSGSPKKSALEGSSASASQSSSEIEVPLLGSSGSSEVELPLLSSKPSSETASSGLTSKTSSEASVSSSVAKNSSSSGTSLLTPKSSSSTNTSLLTSKSTSQVAASLLASKSSSQTSGSLVSKSTSLASVSQLASKSSSQTSTSQLPSKSTSQSSESSVKFSCKLTNEDVKQKQPFFNRLYKTVAWKLVAVGGFSPNVNHGELLNAAIEALKATLDVFFVPLKELADLPQNKSSQESIVCELRCKSVYLGTGCGKSKENAKAVASREALKLFLKKKVVVKICKRKYRGSEIEDLVLLDEESRPVNLPPALKHPQELL

SEQ ID NO: 1220 - protein, 349 aa, Homo sapiens
MPVERMRMRPWLEEQINSNTIPGLKWLNKEKKIFQIPWMHAARHGWDVEKDAPLFRNRAIHTGKHQPGVDKPDPKTWKANFRCAMNSLPDIEEVKDKSIKKGNNAFRVYRMLPLSERPSKKGKKPKTEKEDKVKHIKQEPVESSLGLSNGVSDLSPEYAVLTSTIKNEVDSTVNIIVVGQSHLDSNIENQEIVTNPPDICQVVEVTTESDEQPVSMSELYPLQISPVSSYAESETTDSVPSDEESAEGRPHWRKRNIEGKQYLSNMGTRGSYLLPGMASFVTSNKPDLQVTIKEESNPVPYNSSWPPFQDLPLSSSMTPASSSSRPDRETRASVIKKTSDITQARVKSC

SEQ ID NO: 1221 - protein, 347 aa, Homo sapiens
MKLTSEKLPKNPFYASVSQYAAKNQKFFQWKKEKTDYTHANLVDKALQLLKERILKGDTLAYFLRGQLYFEEGWYEEALEQFEEIKEKDHQATYQLGVMYYDGLGTTLDAEKGVDYMKKILDSPCPKARHLKFAAAYNLGRAYYEGKGVKRSNEEAERLWLIAADNGNPKASVKAQSMLGLYYSTKEPKELEKAFYWHSEACGNGNLESQGALGLMYLYGQGIRQDTEAALQCLREAAERGNVYAQGNLVEYYYKMKFFTKCVAFSKRIADYDEVHDIPMIAQVTDCLPEFIGRGMAMASFYHARCLQLGLGITRDETTAKHYYSKACRLNPALADELHSLLIRQRI

SEQ ID NO: 1222 - protein, 469 aa, Homo sapiens
MVISESMDILFRIRGGLDLAFQLATPNEIFLKKALKHVLSDLSTKLSSNALVFRICHSSVYIWPSSDINTIPGELTDASACKNILRFVQFEPEEDIKRKFMRKKDKKLSDMHQIVNIDLMLEMSTSLAAVTPIIERESGGHHYVNMTLPVDAVISVAPEETWGKVRKLLVDAIHNQLTDMEKCILKYMKGTSIVVPEPLHFLLPGKKNLVTISYPSGIPDGQLQAYRKELHGLFNLPHDRPYFKRSNAYHFPDEPYKDGYIRNPHTYLNPPNMETGMIYVVQGIYGYHHYMQDRIDDNGWGCAYRSLQTICSWFKHQGYTERSIPTHREIQQALVDAGDKPATFVGSRQWIGSIEVQLVLNQLIGITSKILFVSQGSEIASQGRELANHFQSEGTPVMIGGGVLAHTILGVAWNEITGQIKFLILDPHYTGAEDLQVILEKGWCGWKGPDFWNKDAYYNLCLPQRPNMI

SEQ ID NO: 1223 - protein, 199 aa, Homo sapiens
MHRKFVVQLFAEEWGQYVDLPKGFAVSERCKVRLVPLQIQLTTLGNLTPSSTVFFCCDMQERFRPAIKYFGDIISVGQRLLQGARILGIPVIVTEQYPKGLGSTVQEIDLTGVKLVLPKTKFSMVLPEVEAALAEIPGVRSVVLFGVETHVCIQQTALELVGRGVEVHIVADATSSRSMMDRMFARLTSRSNGDHSDHE

SEQ ID NO: 1224 - protein, 275 aa, Homo sapiens
MTDDKDVLRDVWFGRIPTCFTLYQDEITEREAEPYYLLLPRVSYLTLVTDKVKKHFQKVMRQEDISEIWFEYEGTPLKWHYPIGLLFDLLASSSALPWNITVHFKSFPEKDLLHCPSKDAIEAHFMSCMKEADALKHKSQVINEMQKKDHKQLWMGLQNDRFDQFWAINRKLMEYPAEENGFRYIPFRIYQTTTERPFIQKLFRPVAADGQLHTLGDLLKEVCPSAIDPEDGEKKNQVMIHGIEPMLETPLQWLSEHLSYPDNFLHISIIPQPTD

SEQ ID NO: 1225 - protein, 528 aa, Homo sapiens
MLGRSLREVSAALKQGQITPTELCQKCLSLIKKAKFLNAYITVSEEVALKQAEESEKRYKNGQSLGDLDGIPIAVKDNFSTSGIETTCASNMLKGYIPPYNATVVQKLLDQGALLMGKTNLDEFAMGSGSTDGVFGPVKNPWSYSKRYREKRKQNPHSENEDSDWLITGGSPGGSAAAVSAFTCYAALGSDTGGSTRNPAAHCGLVGFKPSYGLVSRHGLIPLVNSMDVPGILTRCVDDAAIVLGALAGPDPRDSTTVHEPINKPFMLPSLADVSKLCIGIPKEYLVPELSSEVQSLWSKAADLFESEGAKVIEVSLPHTSYSIVCYHVLCTSEVASNMARFDGLQYGHRCDIDVSTEAMYAATRREGFNDVVRGRILSGNFFLLKENYENYFVKAQKVRRLIANDFVNAFNSGVDVLLTPTTLSEAVPYLEFIKEDNRTRSAQDDIFTQAVNMAGLPAVSIPVALSNQGLPIGLQFIGRAFCDQQLLTVAKWFEKQVQFPVIQLQELMDDCSAVLENEKLASVSLKQ

SEQ ID NO: 1226 - protein, 399 aa, Homo sapiens
MNFRQLLLHLPRYLGASGSPRRLWWSPSLDTISSVGSWRGRSSKSPAHWNQVVSEAEKIVGYPTSFMSLRCLLSDELSNIAMQVRKLVGTQHPLLTTARGLVHDSWNSLQLRGLVVLLISKAAGPSSVNTSCQNYDMVSGIYSCQRSLAEITELIHIALLVHRGIVNLNELQSSDGPLKDMQFGNKIAILSGDFLLANACNGLALLQNTKVVELLASALMDLVQGVYHENSTSKESYITDDIGISTWKEQTFLSHGALLAKSCQAAMELAKHDAEVQNMAFQYGKHMAMSHKINSDVQPFIKEKTSDSMTFNLNSAPVVLHQEFLGRDLWIKQIREAQEKGRLDYAKLRERIKAGKGVTSAIDLCRYHGNKALEALESFPPSEARSALENIVFAVTRFS

SEQ ID NO: 1227 - protein, 760 aa, Homo sapiens
MAGQQFQYDDSGNTFFYFLTSFVGLIVIPATYYLWPRDQNAEQIRLKNIRKVYGRCMWYRLRLLKPQPNIIPTVKKIVLLAGWALFLFLAYKVSKTDREYQEYNPYEVLNLDPGATVAEIKKQYRLLSLKYHPDKGGDEVMFMRIAKAYAALTDEESRKNWEEFGNPDGPQATSFGIALPAWIVDQKNSILVLLVYGLAFMVILPVVVGSWWYRSIRYSGDQILIRTTQIYTYFVYKTRNMDMKRLIMVLAGASEFDPQYNKDATSRPTDNILIPQLIREIGSINLKKNEPPLTCPYSLKARVLLLSHLARMKIPETLEEDQQFMLKKCPALLQEMVNVICQLIVMARNREEREFRAPTLASLENCMKLSQMAVQGLQQFKSPLLQLPHIEEDNLRRVSNHKKYKIKTIQDLVSLKESDRHTLLHFLEDEKYEEVMAVLGSFPYVTMDIKSQVLDDEDSNNITVGSLVTVLVKLTRQTMAEVFEKEQSICAAEEQPAEDGQGETNKNRTKGGWQQKSKGPKKTAKSKKKKPLKKKPTPVLLPQSKQQKQKQANGVVGNEAAVKEDEEEVSDKGSDSEEEETNRDSQSEKDDGSDRDSDREQDEKQNKDDEAEWQELQQSIQRKERALLETKSKITHPVYSLYFPEEKQEWWWLYIADRKEQTLISMPYHVCTLKDTEEVELKFPAPGKPGNYQYTVFLRSDSYMGLDQIKPLKLEVHEAKPVPENHPQWDTAIEGDEDQEDSEGFEDSFEEEEEEEEDDD

SEQ ID NO: 1228 - protein, 162 aa, Homo sapiens
MAETVADTRRLITKPQNLNDAYGPPSNFLEIDVSNPQTVGVGRGRFTTYEIRVKTNLPIFKLKESTVRRRYSDFEWLRSELERESKVVVPPLPGKAFLRQLPFRGDDGIFDDNFIEERKQGLEQFINKVAGHPLAQNERCLHMFLQDEIIDKSYTPSKIRHA

SEQ ID NO: 1229 - protein, 130 aa, Homo sapiens
MAETVADTRRLITKPQNLNDAYGPPSNFLEIDVSNPQTVGVGRGRFTTYEIRVKVVVPPLPGKAFLRQLPFRGDDGIFDDNFIEERKQGLEQFINKVAGHPLAQNERCLHMFLQDEIIDKSYTPSKIRHA

SEQ ID NO: 1230 - protein, 113 aa, Homo sapiens
MAETVADTRRLITKPQNLNDAYGPPSNFLEIDVSNPQTVGVGRGRFTTYEIRVKTNLPIFKLKESTVRRRYSDFEWLRSELERESKPCLRMTSEARSHGRTWCAQNDEKLFCD

SEQ ID NO: 1231 - protein, 162 aa, Homo sapiens; identical to SEQ ID NO: 1228

SEQ ID NO: 1232 - protein, 130 aa, Homo sapiens; identical to SEQ ID NO: 1229

SEQ ID NO: 1233 - protein, 113 aa, Homo sapiens; identical to SEQ ID NO: 1230

SEQ ID NO: 1234 - protein, 197 aa, Homo sapiens
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTAKPTVQPSPSTTSKTVTTSGTTNNTVTPTSQPVRKSTFDAASFIGGIVLVLGVQAVIFFLYKFCKSKERNYHTL

SEQ ID NO: 1235 - protein, 423 aa, Homo sapiens
MKLNFSLRLRIFNLNCWGIPYLSKHRADRMRRLGDFLNQESFDLALLEEVWSEQDFQYLRQKLSPTYPAAHHFRSGIIGSGLCVFSKHPIQELTQHIYTLNGYPYMIHHGDWFSGKAVGLLVLHLSGMVLNAYVTHLHAEYNRQKDIYLAHRVAQAWELAQFIHHTSKKADVVLLCGDLNMHPEDLGCCLLKEWTGLHDAYLETRDFKGSEEGNTMVPKNCYVSQQELKPFPFGVRIDYVLYKAVSGFYISCKSFETTTGFDPHSGTPLSDHEALMATLFVRHSPPQQNPSSTHGPAERSPLMCVLKEAWTELGLGMAQARWWATFASYVIGLGLLLLALLCVLAAGGGAGEAAILLWTPSVGLVLWAGAFYLFHVQEVNGLYRAQAELQHVLGRAREAQDLGPEPQPALLLGQQEGDRTKEQ

SEQ ID NO: 1236 - protein, 1067 aa, Homo sapiens
MASPTSTNPAHAHFESFLQAQLCQDVLSSFQELCGALGLEPGGGLPQYHKIKDQLNYWSAKSLWTKLDKRAGQPVYQQGRACTSTKCLVVGAGPCGLRVAVELALLGARVVLVEKRTKFSRHNVLHLWPFTIHDLRALGAKKFYGRFCTGTLDHISIRQLQLLLLKVALLLGVEIHWGVTFTGLQPPPRKGSGWRAQLQPNPPAQLANYEFDVLISAAGGKFVPEGFKVREMRGKLAIGITANFVNGRTVEETQVPEISGVARIYNQSFFQSLLKATGIDLENIVYYKDDTHYFVMTAKKQCLLRLGVLRQDWPDTNRLLGSANVVPEALQRFTRAAADFATHGKLGKLEFAQDAHGQPDVSAFDFTSMMRAESSARVQEKHGARLLLGLVGDCLVEPFWPLGTGVARGFLAAFDAAWMVKRWAEGAESLEVLAERESLYQLLSQTSPENMHRNVAQYGLDPATRYPNLNLRAVTPNQVRDLYDVLAKEPVQRNNDKTDTGMPATGSAGTQEELLRWCQEQTAGYPGVHVSDLSSSWADGLALCALVYRLQPGLLEPSELQGLGALEATAWALKVAENELGITPVVSAQAVVAGSDPLGLIAYLSHFHSAFKSMAHSPGPVSQASPGTSSAVLFLSKLQRTLQRSRAKENAEDAGGKKLRLEMEAETPSTEVPPDPEPGVPLTPPSQHQEAGAGDLCALCGEHLYVLERLCVNGHFFHRSCFRCHTCEATLWPGGYEQHPGDGHFYCLQHLPQTDHKKEGSDRGPESPELPTPSENSMPPGLSTPTASQEGAGPVPDPSQPTRRQIRLSSPERQRLSSLNLTPDPEMEPPPKPPRSCSALARHALESSFVGWGLPVQSPQALVAMEKEEKESPFSSEEEEEDVPLDSDVEQALQTFAKTSGTMNNYPTWRRTLLRRAKEEEMKRFCKAQTIQRRLNEIEAALRELEAEGVKLELALRRQSSSPEQQKKLWVGQLLQLVDKKNSLVAEEAELMITVQELNLEEKQWQLDQELRGYMNREENLKTAADRQAEDQVLRKLVDLVNQRDALIRFQEERRLSELALGTGAQG

SEQ ID NO: 1237 - protein, 697 aa, Homo sapiens
MAETSPEPSGQLVVHSDAHSDTVLASFEDQRKKGFLCDITLIVENVHFRAHKALLAASSEYFSMMFAEEGEIGQSIYMLEGMVADTFGILLEFIYTGYLHASEKSTEQILATAQFLKVYDLVKAYTDFQNNHSSPKPTTLNTAGAPVVVISNKKNDPPKRKRGRPKKVNTLQEEKSELAAEEEIQLRVNNSVQNRQNFVVKGDSGVLNEQIAAKEKEESEPTCEPSREEEMPVEKDENYDPKTEDGQASQSRYSKRRIWRSVKLKDYKLVGDQEDHGSAKRICGRRKRPGGPEARCKDCGKVFKYNHFLAIHQRSHTGERPFKCNECGKGFAQKHSLQVHTRMHTGERPYTCTVCSKALTTKHSLLEHMSLHSGQKSFTCDQCGKYFSQNRQLKSHYRVHTGHSLPECKDCHRKFMDVSQLKKHLRTHTGEKPFTCEICGKSFTAKSSLQTHIRIHRGEKPYSCGICGKSFSDSSAKRRHCILHTGKKPFSCPECNLQFARLDNLKAHLKIHSKEKHASDASSISGSSNTEEVRNILQLQPYQLSTSGEQEIQLLVTDSVHNINFMPGPSQGISIVTAESSQNMTADQAANLTLLTQQPEQLQNLILSAQQEQTEHIQSLNMIESQMGPSQTEPVHVITLSKETLEHLHAHQEQTEELHLATSTSDPAQHLQLTQEPGPPPPTHHVPQPTPLGQEQS

SEQ ID NO: 1238 - protein, 907 aa, Homo sapiens
MPTAAAPIISSVQKLVLYETRARYFLVGSNNAETKYRVLKIDRTEPKDLVIIDDRHVYTQQEVRELLGRLDLGNRTKMGQKGSSGLFRAVSAFGVVGFVRFLEGYYIVLITKRRKMADIGGHAIYKVEDTNMIYIPNDSVRVTHPDEARYLRIFQNVDLSSNFYFSYSYDLSHSLQYNLTVLRMPLEMLKSEMTQNRQESFDIFEDEGLITQGGSGVFGICSEPYMKYVWNGELLDIIKSTVHRDWLLYIIHGFCGQSKLLIYGRPVYVTLIARRSSKFAGTRFLKRGANCEGDVANEVETEQILCDASVMSFTAGSYSSYVQVRGSVPLYWSQDISTMMPKPPITLDQADPFAHVAALHFDQMFQRFGSPIIILNLVKEREKRKHERILSEELVAAVTYLNQFLPPEHTIVYIPWDMAKYTKSKLCNVLDRLNVIAESVVKKTGFFVNRPDSYCSILRPDEKWNELGGCVIPTGRLQTGILRTNCVDCLDRTNTAQFMVGKCALAYQLYSLGLIDKPNLQFDTDAVRLFEELYEDHGDTLSLQYGGSQLVHRVKTYRKIAPWTQHSKDIMQTLSRYYSNAFSDADRQDSINLFLGVFHPTEGKPHLWELPTDFYLHHKNTMRLLPTRRSYTYWWTPEVIKHLPLPYDEVICAVNLKKLIVKKFHKYEEEIDIHNEFFRPYELSSFDDTFCLAMTSSARDFMPKTVGIDPSPFTVRKPDETGKSVLGNKSNREEAVLQRKTAASAPPPPSEEAVSSSSEDDSGTDREEEGSVSQRSTPVKMTDAGDSAKVTENVVQPMKELYGINLSDGLSEEDFSIYSRFVQLGQSQHKQDKNSQQPCSRCSDGVIKLTPISAFSQDNIYEVQPPRVDRKSTEIFQAHIQASQGIMQPLGKEDSSMYREYIRNRYL

SEQ ID NO: 1239 - protein, 559 aa, Homo sapiens
MPLVKRNIDPRHLCHTALPRGIKNELECVTNISLANIIRQLSSLSKYAEDIFGELFNEAHSFSFRVNSLQERVDRLSVSVTQLDPKEEELSLQDITMRKAFRSSTIQDQQLFDRKTLPIPLQETYDVCEQPPPLNILTPYRDDGKEGLKFYTNPSYFFDLWKEKMLQDTEDKRKEKRKQKQKNLDRPHEPEKVPRAPHDRRREWQKLAQGPELAEDDANLLHKHIEVANGPASHFETRPQTYVDHMDGSYSLSALPFSQMSELLTRAEERVLVRPHEPPPPPPMHGAGDAKPIPTCISSATGLIENRPQSPATGRTPVFVSPTPPPPPPPLPSALSTSSLRASMTSTPPPPVPPPPPPPATALQAPAVPPPPAPLQIAPGVLHPAPPPIAPPLVQPSPPVARAAPVCETVPVHPLPQGEVQGLPPPPPPPPLPPPGIRPSSPVTVTALAHPPSGLHPTPSTAPGPHVPLMPPSPPSQVIPASEPKRHPSTLPVISDARSVLLEAIRKGIQLRKVEEQREQEAKHERIENDVATILSRRIAVEYSDSEDDSEFDEVDWLE

SEQ ID NO: 1240 - protein, 579 aa, Homo sapiens
MSAAIAALAASYGSGSGSESDSDSESSRCPLPAADSLMHLTKSPSSKPSLAVAVDSAPEVAVKEDLETGVHLDPAVKEVQYNPTYETMFAPEFGPENPFRTQQMAAPRNMLSGYAEPAHINDFMFEQQRRTFATYGYALDPSLDNHQVSAKYIGSVEEAEKNQGLTVFETGQKKTEKRKKFKENDASNIDGFLGPWAKYVDEKDVAKPSEEEQKELDEITAKRQKKGKQEEEKPGEEKTILHVKEMYDYQGRSYLHIPQDVGVNLRSTMPPEKCYLPKKQIHVWSGHTKGVSAVRLFPLSGHLLLSCSMDCKIKLWEVYGERRCLRTFIGHSKAVRDICFNTAGTQFLSAAYDRYLKLWDTETGQCISRFTNRKVPYCVKFNPDEDKQNLFVAGMSDKKIVQWDIRSGEIVQEYDRHLGAVNTIVFVDENRRFVSTSDDKSLRVWEWDIPVDFKYIAEPSMHSMPAVTLSPNGKWLACQSMDNQILIFGAQNRFRLNKKKIFKGHMVAGYACQVDFSPDMSYVISGDGNGKLNIWDWKTTKLYSRFKAHDKVCIGAVWHPHETSKVITCGWDGLIKLWD

SEQ ID NO: 1241 - protein, 502 aa, Homo sapiens
MDYDFKAKLAAERERVEDLFEYEGCKVGRGTYGHVYKARRKDGKDEKEYALKQIEGTGISMSACREIALLRELKHPNVIALQKVFLSHSDRKVWLLFDYAEHDLWHIIKFHRASKANKKPMQLPRSMVKSLLYQILDGIHYLHANWVLHRDLKPANILVMGEGPERGRVKIADMGFARLFNSPLKPLADLDPVVVTFWYRAPELLLGARHYTKAIDIWAIGCIFAELLTSEPIFHCRQEDIKTSNPFHHDQLDRIFSVMGFPADKDWEDIRKMPEYPTLQKDFRRTTYANSSLIKYMEKHKVKPDSKVFLLLQKLLTMDPTKRITSEQALQDPYFQEDPLPTLDVFAGCQIPYPKREFLNEDDPEEKGDKNQQQQQNQHQQPTAPPQQAAAPPQAPPPQQNSTQTNGTAGGAGAGVGGTGAGLQHSQDSSLNQVPPNKKPRLGPSGANSGGPVMPSDYQHSSSRLNYQSSVQGSSQSQSTLGYSSSSQQSSQYHPSHQAHRY

SEQ ID NO: 1242 - protein, 502 aa, Homo sapiens; identical to SEQ ID NO: 1241

SEQ ID NO: 1243 - protein, 334 aa, Homo sapiens
MEAAHFFEGTEKLLEVWFSRQQPDANQGSGDLRTIPRSEWDILLKDVQCSIISVTKTDKQEAYVLSESSMFVSKRRFILKTCGTTLLLKALVPLLKLARDYSGFDSIQSFFYSRKNFMKPSHQGYPHRNFQEEIEFLNAIFPNGAGYCMGRMNSDCWYLYTLDFPESRVISQPDQTLEILMSELDPAVMDQFYMKDGVTAKDVTRESGIRDLIPGSVIDATMFNPCGYSMNGMKSDGTYWTIHITPEPEFSYVSFETNLSQTSYDDLIRKVVEVFKPGKFVTTLFVNQSSKCRTVLASPQKIEGFKRLDCQSAMFNDYNFVFTSFAKKQQQQQS

SEQ ID NO: 1244 - protein, 3052 aa, Homo sapiens
MAFSIDRALNVALGNPSSTAQHVFKVSLVSGMPFYGYHEKERHFMKIYLYNPTMVKRICELLQSGAIMNKFYQPHEAHIPYLLQLFIDYNLYGMNLINLAAVKFRKARRKSNTLHATGSCKNHLSGNSLADTLFRWEQDEIPSSLILEGVEPHSTCELQVDAVAADILNRLDIEAQIGGNPGLQAIWEDEKQRRRNRNETSQMSQPESQDHRFVPATESEKKFQKRLQEILKQNDFSVTLSGSVDYSDGSQEFSAELTLHSEVLSPEMLQCTPANMVEVHKDKESSKGHTRHKVEEALINEEAILNLMENSQTFQPLTQRLSESPVFMDSSPDEALVHLLAGLESDGYRGERNRMPSPCRSFGNNKYPQNSDDEENEPQIEKEEMELSLVMSQRWDSNIEEHCAKKRSLCRNTHRSSTEDDDSSSGEEMEWSDNSLLLASLSIPQLDGTADENSDNPLNNENSRTHSSVIATSKLSVKPSIFHKDAATLEPSSSAKITFQCKHTSALSSHVLNKEDLIEDLSQTNKNTEKGLDNSVTSFTNESTYSMKYPGSLSSTVHSENSHKENSKKEILPVSSCESSIFDYEEDIPSVTRQVPSRKYTNIRKIEKDSPFIHMHRHPNENTLGKNSFNFSDLNHSKNKVSSEGNEKGNSTALSSLFPSSFTENCELLSCSGENRTMVHSLNSTADESGLNKLKIRYEEFQEHKTEKPSLSQQAAHYMFFPSVVLSNCLTRPQKLSPVTYKLQPGNKPSRLKLNKRKLAGHQETSTKSSETGSTKDNFIQNNPCNSNPEKDNALASDLTKTTRGAFENKTPTDGFIDCHFGDGTLETEQSFGLYGNKYTLRAKRKVNYETEDSESSFVTHNSKISLPHPMEIGESLDGTLKSRKRRKMSKKLPPVIIKYIIINRFRGRKNMLVKLGKIDSKEKQVILTEEKMELYKKLAPLKDFWPKVPDSPATKYPIYPLTPKKSHRRKSKHKSAKKKTGKQQRTNNENIKRTLSFRKKRSHAILSPPSPSYNAETEDCDLNYSDVMSKLGFLSERSTSPINSSPPRCWSPTDPRAEEIMAAAEKEAMLFKGPNVCKKTVNSRIGKTSRARAQIKKSKAKLANPSIVTKKRNKRNQTNKLVDDGKKKPRAKQKTNEKGTSRKHITLKDEKIKSQSGAEVKFVLKHQNVSEFASSSGGSQLLFKQKDMPLMGSAVDHPLSASLPTGINAQQKLSGCFSSFLESKKSVDLQTFPSSRDDLHPSVVCNSIGPGVSKINVQRPHNQSAMFTLKESTLIQKNIFDLSNHLSQVAQNTQISSGMSSKIEDNANNIQRNYLSSIGKLSEYRNSLESKLDQAYTPNFLHCKDSQQQIVCIAEQSKHSETCSPGNTASEESQMPNNCFVTSLRSPIKQIAWEQKQRGFILDMSNFKPERVKPRSLSEAISQTKALSQCKNRNVSTPSAFGEGQSGLAVLKELLQKRQQEAQNANTTQDPLSNKHQPNKNISGSLEHNKANKRTRSVTSPRKPRTPRSTKQKEKIPKLLKVDSLNLQNSSQLDNSVSDDSPIFFSDPGFESCYSLEDSLSPEHNYNFDINTIGQTGFCSFYSGSQFVPADQNLPQKFLSDAVQDLFPGQAIEKNEFLSHDNQKCDEDKHHTTDSASWIRSGTLSPEIFEKSTIDSNENRRHNQWKNSFHPLTTRSNSIMDSFCVQQAEDCLSEKSRLNRSSVSKEVFLSLPQPNNSDWIQGHTRKEMGQSLDSANTSFTAILSSPDGELVDVACEDLELYVSRNNDMLTPTPDSSPRSTSSPSQSKNGSFTPRTANILKPLMSPPSREEIMATLLDHDLSETIYQEPFCSNPSDVPEKPREIGGRLLMVETRLANDLAEFEGDFSLEGLRLWKTAFSAMTQNPRPGSPLRSGQGVVNKGSSNSPKMVEDKKIVIMPCKCAPSRQLVQVWLQAKEEYERSKKLPKTKPTGVVKSAENFSSSVNPDDKPVVPPKMDVSPCILPTTAHTKEDVDNSQIALQAPTTGCSQTASESQMLPPVASASDPEKDEDDDDNYYISYSSPDSPVIPPWQQPISPDSKALNGDDRPSSPVEELPSLAFENFLKPIKDGIQKSPCSEPQEPLVISPINTRARTGKCESLCFHSTPIIQRKLLERLPEAPGLSPLSTEPKTQKLSNKKGSNTDTLRRVLLTQAKNQFAAVNTPQKETSQIDGPSLNNTYGFKVSIQNLQEAKALHEIQNLTLISVELHARTRRDLEPDPEFDPICALFYCISSDTPLPDTEKTELTGVIVIDKDKTVFSQDIRYQTPLLIRSGITGLEVTYAADEKALFHEIANIIKRYDPDILLGYEIQMHSWGYLLQRAAALSIDLCRMISRVPDDKIENRFAAERDEYGSYTMSEINIVGRITLNLWRIMRNEVALTNYTFENVSFHVLHQRFPLFTFRVLSDWFDNKTDLYRWKMVDHYVSRVRGNLQMLEQLDLIGKTSEMARLFGIQFLHVLTRGSQYRVESMMLRIAKPMNYIPVTPSVQQRSQMRAPQCVPLIMEPESRFYSNSVLVLDFQSLYPSIVIAYNYCFSTCLGHVENLGKYDEFKFGCTSLRVPPDLLYQVRHDITVSPNGVAFVKPSVRKGVLPRMLEEILKTRFMVKQSMKAYKQDRALSRMLDARQLGLKLIANVTFGYTSANFSGRMPCIEVGDSIVHKARETLERAIKLVNDTKKWGARVVYGDTDSMFVLLKGATKEQSFKIGQEIAEAVTATNPKPVKLKFEKVYLPCVLQTKKRYVGYMYETLDQKDPVFDAKGIETVRRDSCPAVSKILERSLKLLFETRDISLIKQYVQRQCMKLLEGKASIQDFIFAKEYRGSFSYKPGACVPALELTRKMLTYDRRSEPQVGERVPYVIIYGTPGVPLIQLVRRPVEVLQDPTLRLNATYYITKQILPPLARIFSLIGIDVFSWYHELPRIHKATSSSRSEPEGRKGTISQYFTTLHCPVCDDLTQHGICSKCRSQPQHVAVILNQEIRELERQQEQLVKICKNCTGCFDRHIPCVSLNCPVLFKLSRVNRELSKAPYLRQLLDQF

SEQ ID NO: 1245 - protein, 488 aa, Homo sapiens
MAYSQGGGKKKVCYYYDGDIGNYYYGQGHPMKPHRIRMTHNLLLNYGLYRKMEIYRPHKATAEEMTKYHSDEYIKFLRSIRPDNMSEYSKQMHIFNVGEDCPAFDGLFEFCQLSTGGSVAGAVKLNRQQTDMAVNWAGGLHHAKKYEASGFCYVNDIVLAILELLKYHQRVLYIDIDIHHGDGVEEAFYTTDRVMTVSFHKYGEYFPGTGDLRDIGAGKGKYYAVNFPMCDGIDDESYGQIFKPIISKVMEMYQPSAVVLQCGADSLSGDRLGCFNLTVKGHAKCVEVVKTFNLPLLMLGGGGYTIRNVARCWTYETAVALDCEIPNELPYNDYFEYFGPDFKLHISPSNMTNQNTPEYMEKIKQRLFENLRMLPHAPGVQMQAIPEDAVHEDSGDEDGEDPDKRISIRASDKRIACDEEFSDSEDEGEGGRRNVADHKKGAKKARIEEDKKETEDKKTDVKEEDKSKDNSGEKTDTKGTKSEQLSNP

SEQ ID NO: 1246 - protein, 437 aa, Homo sapiens
MSGLDGVKRTTPLQTHSIIISDQVPSDQDAHQYLRLRDQSEATQVMAEPGEGGSETVALPPPPPSEEGGVPQDAAGRGGTPQIRVVGGRGHVAIKAGQEEGQPPAEGLAAASVVMAADRSLKKGVQGGEKALEICGAQRSASELTAGAEAEAEEVKTGKCATVSAAVAERESAEVVKEGLAEKEVMEEQMEVEEQPPEGEEIEVAEEDRLEEEAREEEGPWPLHEALRMDPLEAIQLELDTVNAQADRAFQQLEHKFGRMRRHYLERRNYIIQNIPGFWMTAFRNHPQLSAMIRGQDAEMLRYITNLEVKELRHPRTGCKFKFFFRRNPYFRNKLIVKEYEVRSSGRVVSLSTPIIWRRGHEPQSFIRRNQDLICSFFTWFSDHSLPESDKIAEIIKEDLWPNPLQYYLLREGVRRARRRPLREPVEIPRPFGFQSG

SEQ ID NO: 1247 - protein, 204 aa, Homo sapiens
MAKVQVNNVVVLDNPSPFYNPFQFEITFECIEDLSEDLEWKIIYVGSAESEEYDQVLDSVLVGPVPAGRHMFVFQADAPNPGLIPDADAVGVTVVLITCTYRGQEFIRVGYYVNNEYTETELRENPPVKPDFSKLQRNILASNPRVTRFHINWEDNTEKLEDAESSNPNLQSLLSTDALPSASKGWSTSENSLNVMLESHMDCM

SEQ ID NO: 1248 - protein, 684 aa, Homo sapiens
MARHRNVRGYNYDEDFEDDDLYGQSVEDDYCISPSTAAQFIYSRRDKPSVEPVEEYDYEDLKESSNSVSNHQLSGFDQARLYSCLDHMREVLGDAVPDEILIEAVLKNKFDVQKALSGVLEQDRVQSLKDKNEATVSTGKIAKGKPVDSQTSRSESEIVPKVAKMTVSGKKQTMGFEVPGVSSEENGHSFHTPQKGPPIEDAIASSDVLETASKSANPPHTIQASEEQSSTPAPVKKSGKLRQQIDVKAELEKRQGGKQLLNLVVIGHVDAGKSTLMGHMLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPVLLHYQTVSEPAVIKRLISVLNKSTGEVTKKKPKFLTKGQNALVELQTQRPIALELYKDFKELGRFMLRYGGSTIAAGVVTEIKE

SEQ ID NO: 1249 - protein, 1196 aa, Homo sapiens
MPTAESEAKVKTKVRFEELLKTHSDLMREKKKLKKKLVRSEENISPDTIRSNLHYMKETTSDDPDTIRSNLPHIKETTSDDVSAANTNNLKKSTRVTKNKLRNTQLATENPNGDASVEEDKQGKPNKKVIKTVPQLTTQDLKPETPENKVDSTHQKTHTKPQPGVDHQKSEKANEGREETDLEEDEELMQAYQCHVTEEMAKEIKRKIRKKLKEQLTYFPSDTLFHDDKLSSEKRKKKKEVPVFSKAETSTLTISGDTVEGEQKKESSVRSVSSDSHQDDEISSMEQSTEDSMQDDTKPKPKKTKKKTKAVADNNEDVDGDGVHEITSRDSPVYPKCLLDDDLVLGVYIHRTDRLKSDFMISHPMVKIHVVDEHTGQYVKKDDSGRPVSSYYEKENVDYILPIMTQPYDFKQLKSRLPEWEEQIVFNENFPYLLRGSDESPKVILFFEILDFLSVDEIKNNSEVQNQECGFRKIAWAFLKLLGANGNANINSKLRLQLYYPPTKPRSPLSVVEAFEWWSKCPRNHYPSTLYVTVRGLKVPDCIKPSYRSMMALQEEKGKPVHCERHHESSSVDTEPGLEESKEVIKWKRLPGQACRIPNKHLFSLNAGERGCFCLDFSHNGRILAAACASRDGYPIILYEIPSGRFMRELCGHLNIIYDLSWSKDDHYILTSSSDGTARIWKNEINNTNTFRVLPHPSFVYTAKFHPAVRELVVTGCYDSMIRIWKVEMREDSAILVRQFDVHKSFINSLCFDTEGHHMYSGDCTGVIVVWNTYVKINDLEHSVHHWTINKEIKETEFKGIPISYLEIHPNGKRLLIHTKDSTLRIMDLRILVARKFVGAANYREKIHSTLTPCGTFLFAGSEDGIVYVWNPETGEQVAMYSDLPFKSPIRDISYHPFENMVAFCAFGQNEPILLYIYDFHVAQQEAEMFKRYNGTFPLPGIHQSQDALCTCPKLPHQGSFQIDEFVHTESSSTKMQLVKQRLETVTEVIRSCAAKVNKNLSFTSPPAVSSQQSKLKQSNMLTAQEILHQFGFTQTGIISIERKPCNHQVDTAPTVVALYDYTANRSDELTIHRGDIIRVFFKDNEDWWYGSIGKGQEGYFPANHVASETLYQELPPEIKERSPPLSPEEKTKIEKSPAPQKQSINKNKSQDFRLGSESMTHSEMRKEQSHEDQGHIMDTRMRKNKQAGRKVTLIE

SEQ ID NO: 1250 - protein, 1374 aa, Homo sapiens
MSTEADEGITFSVPPFAPSGFCTIPEGGICRRGGAAAVGEGEEHQLPPPPPGSFWNVESAAAPGIGCPAATSSSSATRGRGSSVGGGSRRTTVAYVINEASQGQLVVAESEALQSLREACETVGATLETLHFGKLDFGETTVLDRFYNADIAVVEMSDAFRQPSLFYHLGVRESFSMANNIILYCDTNSDSLQSLKEIICQKNTMCTGNYTFVPYMITPHNKVYCCDSSFMKGLTELMQPNFELLLGPICLPLVDRFIQLLKVAQASSSQYFRESILNDIRKARNLYTGKELAAELARIRQRVDNIEVLTADIVINLLLSYRDIQDYDSIVKLVETLEKLPTFDLASHHHVKFHYAFALNRRNLPGDRAKALDIMIPMVQSEGQVASDMYCLVGRIYKDMFLDSNFTDTESRDHGASWFKKAFESEPTLQSGINYAVLLLAAGHQFESSFELRKVGVKLSSLLGKKGNLEKLQSYWEVGFFLGASVLANDHMRVIQASEKLFKLKTPAWYLKSIVETILIYKHFVKLTTEQPVAKQELVDFWMDFLVEATKTDVTVVRFPVLILEPTKIYQPSYLSINNEVEEKTISIWHVLPDDKKGIHEWNFSASSVRGVSISKFEERCCFLYVLHNSDDFQIYFCTELHCKKFFEMVNTITEEKGRSTEEGDCESDLLEYDYEYDENGDRVVLGKGTYGIVYAGRDLSNQVRIAIKEIPERDSRYSQPLHEEIALHKHLKHKNIVQYLGSFSENGFIKIFMEQVPGGSLSALLRSKWGPLKDNEQTIGFYTKQILEGLKYLHDNQIVHRDIKGDNVLINTYSGVLKISDFGTSKRLAGINPCTETFTGTLQYMAPEIIDKGPRGYGKAADIWSLGCTIIEMATGKPPFYELGEPQAAMFKVGMFKVHPEIPESMSAEAKAFILKCFEPDPDKRACANDLLVDEFLKVSSKKKKTQPKLSALSAGSNEYLRSISLPVPVLVEDTSSSSEYGSVSPDTELKVDPFSFKTRAKSCGERDVKGIRTLFLGIPDENFEDHSAPPSPEEKDSGFFMLRKDSERRATLHRILTEDQDKIVRNLMESLAQGAEEPKLKWEHITTLIASLREFVRSTDRKIIATTLSKLKLELDFDSHGISQVQVVLFGFQDAVNKVLRNHNIKPHWMFALDSIIRKAVQTAITILVPELRPHFSLASESDTADQEDLDVEDDHEEQPSNQTVRRPQAVIEDAVATSGVSTLSSTVSHDSQSAHRSLNVQLGRMKIETNRLLEELVRKEKELQALLHRAIEEKDQEIKHLKLKSQPIEIPELPVFHLNSSGTNTEDSELTDWLRVNGADEDTISRFLAEDYTLLDVLYYVTRDDLKCLRLRGGMLCTLWKAIIDFRNKQT

SEQ ID NO: 1251 - protein, 553 aa, Homo sapiens
MRAPGRPALRPLPLPPLLLLLLAAPWGRAVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPVSITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 1252 - protein, 205 aa, Homo sapiens
MAEPLQPDPGAAEDAAAQAVETPGWKAPEDAGPQPGSYEIRHYGPAKWVSTSVESMDWDSAIQTGFTKLNSYIQGKNEKEMKIKMTAPVTSYVEPGSGPFSESTITISLYIPSEQQFDPPRPLESDVFIEDRAEMTVFVRSFDGFSSAQKNQEQLLTLASILREDGKVFDEKVYYTAGYNSPVKLLNRNNEVWLIQKNEPTKENE

SEQ ID NO: 1253 - protein, 274 aa, Homo sapiens
MPRAEPRATLGEQEKAGLPLGAWRLYLLRHFRKQTELRRSGSRDVTGALLVAAAVASEAVGSLRVAEGGPNTLLLQVLRSWPWCNKELKTMEERKVKRRSPKSFSAHCTQVVNAKKNAIPVSKSTGFSNPASQSTSQRPKLKRVMKEKTKPQGGEGKGAQSTPIQHSFLTDVSDVQEMERGLLSLLNDFHSGKLQAFGNECSIEQMEHVRGMQEKLARLNLELYGELEELPEDKRKTASDSNLDRLLSDLEELNSSIQKLHLADAQDVPNTSAS

SEQ ID NO: 1254 - protein, 543 aa, Homo sapiens
MPNPKNSKGGRKNKRANSSGDEQENGAGALAAAGAAGAAAGGALAAAAGCGAAAAGAPGAGGAAGAGGAGTGAANAAAAAGAAAAGDAKNEAPCATPLICSFGRPVDLEKDDYQKVVCNNEHCPCSTWMHLQCFYEWESSILVQFNCIGRARSWNEKQCRQNMWTKKGYDLAFRFCSCRCGQGHLKKDTDWYQVKRMQDEKKKKSGSEKNTGRPPGEAAEEAKKCRPPNKPQKGPSHDLPRRHSMDRQNSQEKAVGAAAYGARSPGGSPGQSPPTGYSILSPAHFSGPRSSRYLGEFLKNAIHLEPHKKAMAGGHVFRNAHFDYSPAGLAVHRGGHFDTPVQFLRRLDLSELLTHIPRHKLNTFHVRMEDDAQVGQGEDLRKFILAALSASHRNVVNCALCHRALPVFEQFPLVDGTLFLSPSRHDEIEYDVPCHLQGRLMHLYAVCVDCLEGVHKIICIKCKSRWDGSWHQLGTMYTYDILAASPCCQARLNCKHCGKPVIDVRIGMQYFSEYSNVQQCPHCGNLDYHFVKPFSSFKVLEAY

SEQ ID NO: 1255 - protein, 1194 aa, Homo sapiens
MVGLLLFFFPAIFLEVSLLPRSPGRKVLLAGASSQRSVARMDGDVIIGALFSVHHQPPAEKVPERKCGEIREQYGIQRVEAMFHTLDKINADPVLLPNITLGSEIRDSCWHSSVALEQSIEFIRDSLISIRDEKDGINRCLPDGQSLPPGRTKKPIAGVIGPGSSSVAIQVQNLLQLFDIPQIAYSATSIDLSDKTLYKYFLRVVPSDTLQARAMLDIVKRYNWTYVSAVHTEGNYGESGMDAFKELAAQEGLCIAHSDKIYSNAGEKSFDRLLRKLRERLPKARVVVCFCEGMTVRGLLSAMRRLGVVGEFSLIGSDGWADRDEVIEGYEVEANGGITIKLQSPEVRSFDDYFLKLRLDTNTRNPWFPEFWQHRFQCRLPGHLLENPNFKRICTGNESLEENYVQDSKMGFVINAIYAMAHGLQNMHHALCPGHVGLCDAMKPIDGSKLLDFLIKSSFIGVSGEEVWFDEKGDAPGRYDIMNLQYTEANRYDYVHVGTWHEGVLNIDDYKIQMNKSGVVRSVCSEPCLKGQIKVIRKGEVSCCWICTACKENEYVQDEFTCKACDLGWWPNADLTGCEPIPVRYLEWSNIESIIAIAFSCLGILVTLFVTLIFVLYRDTPVVKSSSRELCYIILAGIFLGYVCPFTLIAKPTTTSCYLQRLLVGLSSAMCYSALVTKTNRIARILAGSKKKICTRKPRFMSAWAQVIIASILISVQLTLVVTLIIMEPPMPILSYPSIKEVYLICNTSNLGVVAPLGYNGLLIMSCTYYAFKTRNVPANFNEAKYIAFTMYTTCIIWLAFVPIYFGSNYKIITTCFAVSLSVTVALGCMFTPKMYIIIAKPERNVRSAFTTSDVVRMHVGDGKLPCRSNTFLNIFRRKKAGAGNANSNGKSVSWSEPGGGQVPKGQHMWHRLSVHVKTNETACNQTAVIKPLTKSYQGSGKSLTFSDTSTKTLYNVEEEEDAQPIRFSPPGSPSMVVHRRVPSAATTPPLPPHLTAEETPLFLAEPALPKGLPPPLQQQQQPPPQQKSLMDQLQGVVSNFSTAIPDFHAVLAGPGGPGNGLRSLYPPPPPPQHLQMLPLQLSTFGEELVSPPADDDDDSERFKLLQEYVYEHEREGNTEEDELEEEEEDLQAASKLTPDDSPALTPPSPFRDSVASGSSVPSSPVSESVLCTPPNVSYASVILRDYKQSSSTL

SEQ ID NO: 1256 - protein, 410 aa, Homo sapiens
MLQEQVSEYLGVTSFKRKYPDLERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKPKVIPNAICGICLKGKESNKKGKAESLIHCSQCENSGHPSCLDMTMELVSMIKTYPWQCMECKTCIICGQPHHEEEMMFCDMCDRGYHTFCVGLGAIPSGRWICDCCQRAPPTPRKVGRRGKNSKEG

SEQ ID NO: 1257 - protein, 408 aa, Homo sapiens
MLQEQVSEYLGVTSFKRKYPERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKPKVIPNAICGICLKGKESNKKGKAESLIHCSQCENSGHPSCLDMTMELVSMIKTYPWQCMECKTCIICGQPHHEEEMMFCDMCDRGYHTFCVGLGAIPSGRWICDCCQRAPPTPRKVGRRGKNSKEG

SEQ ID NO: 1258 - protein, 410 aa, Homo sapiens; identical to SEQ ID NO: 1256

SEQ ID NO: 1259 - protein, 408 aa, Homo sapiens; identical to SEQ ID NO: 1257

SEQ ID NO: 1260 - protein, 290 aa, Homo sapiens
MDIEAYLERIGYKKSRNKLDLETLTDILQHQIRAVPFENLNIHCGDAMDLGLEAIFDQVVRRNRGGWCLQVNHLLYWALTTIGFETTMLGGYVYSTPAKKYSTGMIHLLLQVTIDGRNYIVDAGFGRSYQMWQPLELISGKDQPQVPCVFRLTEENGFWYLDQIRREQYIPNEEFLHSDLLEDSKYRKIYSFTLKPRTIEDFESMNTYLQTSPSSVFTSKSFCSLQTPDGVHCLVGFTLTHRRFNYKDNTDLIEFKTLSEEEIEKVLKNIFNISLQRKLVPKHGDRFFTI

SEQ ID NO: 1261 - protein, 699 aa, Homo sapiens
MEGRSAAAETFVWVNNASAHSQSVAKAKYEFLFGRSEGKAPDTSDHGGSTLLPPNVTNEFPEYGTMEEGGEGLRASLEFDGEALPCHPQEQQGVQPLTGCHSGLDSVTEGPKDVREAPSQSHLKEQSLQPIDSLISALKATEARIISGTLQATKVLDQDAVSSFSVQQVEKELDTASRKTQRVNKLLPAGQKNLPEIPLSAEVTTEESFYLSIQKDLTALLTGDTQAEISQIMNNGRKGAVCVQEPSCPLASLGSSAVTCHSAGSVGFLKEQRSALGREHPGGCDRSSSMGRPGRVKHVEFQGVEILWTGGDKRETQHPIDFETSLQRTASPDSKESSKVPRHLISSAGLCNSSSLTENVWDESWKAPSERPGTSSGTFSPVRLDESGEDEVFLQENKQHLEKTPKPERDRERISEQEEHVKGEDEDILGPGYTEDSTDVYSSQFETILDNTSLYYSAESLETLYSEPDSYFSFEMPLTPMIQQRIKEGGQFLERTSGGGHQDILSVSADGGIVMGYSSGVTNGLNDASDSIYTKGTPEIAFWGSNAGVKTTRLEAHSEMGSTEILEKETPENLSNGTSSNVEAAKRLAKRLYQLDRFKRSDVAKHLGKNNEFSKLVAEEYLKFFDFTGMTLDQSLRYFFKAFSLVGETQERERVLIHFSNRYFYCNPDTIASQDGVHCLTCAIMLLNTDLHGQILERR

SEQ ID NO: 1262 - protein, 511 aa, Homo sapiens
MALRAMRGIVNGAAPELPVPTGGPAVGAREQALAVSRNYLSQPRLTYKTVSGVNGPLVILDHVKFPRYAEIVHLTLPDGTKRSGQVLEVSGSKAVVQVFEGTSGIDAKKTSCEFTGDILRTPVSEDMLGRVFNGSGKPIDRGPVVLAEDFLDIMGQPINPQCRIYPEEMIQTGISAIDGMNSIARGQKIPIFSAAGLPHNEIAAQICRQAGLVKKSKDVVDYSEENFAIVFAAMGVNMETARFFKSDFEENGSMDNVCLFLNLANDPTIERIITPRLALTTAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHADVSNQLYACYAIGKDVQAMKAVVGEEALTSDDLLYLEFLQKFERNFIAQGPYENRTVFETLDIGWQLLRIFPKEMLKRIPQSTLSEFYPRDSAKH

SEQ ID NO: 1263 - protein, 919 aa, Homo sapiens
MTGYTMLRNGGAGNGGQTCMLRWSNRIRLTWLSFTLFVILVFFPLIAHYYLTTLDEADEAGKRIFGPRVGNELCEVKHVLDLCRIRESVSEELLQLEAKRQELNSEIAKLNLKIEACKKSIENAKQDLLQLKNVISQTEHSYKELMAQNQPKLSLPIRLLPEKDDAGLPPPKATRGCRLHNCFDYSRCPLTSGFPVYVYDSDQFVFGSYLDPLVKQAFQATARANVYVTENADIACLYVILVGEMQEPVVLRPAELEKQLYSLPHWRTDGHNHVIINLSRKSDTQNLLYNVSTGRAMVAQSTFYTVQYRPGFDLVVSPLVHAMSEPNFMEIPPQVPVKRKYLFTFQGEKIESLRSSLQEARSFEEEMEGDPPADYDDRIIATLKAVQDSKLDQVLVEFTCKNQPKPSLPTEWALCGEREDRLELLKLSTFALIITPGDPRLVISSGCATRLFEALEVGAVPVVLGEQVQLPYQDMLQWNEAALVVPKPRVTEVHFLLRSLSDSDLLAMRRQGRFLWETYFSTADSIFNTVLAMIRTRIQIPAAPIREEAAAEIPHRSGKAAGTDPNMADNGDLDLGPVETEPPYASPRYLRNFTLTVTDFYRSWNCAPGPFHLFPHTPFDPVLPSEAKFLGSGTGFRPIGGGAGGSGKEFQAALGGNVPREQFTVVMLTYEREEVLMNSLERLNGLPYLNKVVVVWNSPKLPSEDLLWPDIGVPIMVVRTEKNSLNNRFLPWNEIETEAILSIDDDAHLRHDEIMFGFRVWREARDRIVGFPGRYHAWDIPHQSWLYNSNYSCELSMVLTGAAFFHKYYAYLYSYVMPQAIRDMVDEYINCEDIAMNFLVSHITRKPPIKVTSRWTFRCPGCPQALSHDDSHFHERHKCINFFVKVYGYMPLLYTQFRVDSVLFKTRLPHDKTKCFKFI

SEQ ID NO: 1264 - protein, 919 aa, Homo sapiens; identical to SEQ ID NO: 1263

SEQ ID NO: 1265 - protein, 658 aa, Homo sapiens
MKLYCLSGHPTLPCNVLKFKSTTIMLDCGLDMTSTLNFLPLPLVQSPRLSNLPGWSLKDGNAFLDKELKECSGHVFVDSVPEFCLPETELIDLSTVDVILISNYHCMMALPYITEHTGFTGTVYATEPTVQIGRLLMEELVNFIERVPKAQSASLWKNKDIQRLLPSPLKDAVEVSTWRRCYTMQEVNSALSKIQLVGYSQKIELFGAVQVTPLSSGYALGSSNWIIQSHYEKVSYVSGSSLLTTHPQPMDQASLKNSDVLVLTGLTQIPTANPDGMVGEFCSNLALTVRNGGNVLVPCYPSGVIYDLLECLYQYIDSAGLSSAPLYFISPVANSSLEFSQIFAEWLCHNKQSKVYLPEPPFPHAELIQTNKLKHYPSIHGDFSNDFRQPCVVFTGHPSLRFGDVVHFMELWGKSSLNTVIFTEPDFSYLEALAPYQPLAMKCIYCPIDTRLNFIQVSKLLKEVQPLHVVCPEQYTQPPPAQSHRMDLMIDCQPPAMSYRRAEVLALPFKRRYEKIEIMPELADSLVPMEIKPGISLATVSAVLHTKDNKHLLQPPPRPAQPTSGKKRKRVSDDVPDCKVLKPLLSGSIPVEQFVQTLEKHGFSDIKVEDTAKGHIVLLQEAETLIQIEEDSTHIICDNDEMLRVRLRDLVLKFLQKF

SEQ ID NO: 1266 - protein, 339 aa, Homo sapiens
MAAACGPGAAGYCLLLGLHLFLLTAGPALGWNDPDRMLLRDVKALTLHYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGLQKLKESGKQHGFASFSDYYYKWSSADSCNMSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAATPFSDSWYYPSYPPSYPGTWNRAYSPLHGGSGSYSVCSNSDTKTRTASGYGGTRRR

SEQ ID NO: 1267 - protein, 131 aa, Homo sapiens
MAGIKALISLSFGGAIGLMFLMLGCALPIYNKYWPLFVLFFYILSPIPYCIARRLVDDTDAMSNACKELAIFLTTGIVVSAFGLPIVFARAHLIEWGACALVLTGNTVIFATILGFFLVFGSKDDFSWQQW

SEQ ID NO: 1268 - protein, 190 aa, Homo sapiens
MAEKTQKSVKIAPGAVVCVESEIRGDVTIGPRTVIHPKARIIAEAGPIVIGEGNLIEEQALIINAYPDNITPDTEDPEPKPMIIGTNNVFEVGCYSQAMKMGDNNVIESKAYVGRNVILTSGCIIGACCNLNTFEVIPENTVIYGADCLRRVQTERPQPQTLQLDFLMKILPNYHHLKKTMKGSSTPVKN

SEQ ID NO: 1269 - protein, 196 aa, Homo sapiens
MNNGGKAEKENTPSEANLQEEEVRTLFVSGLPLDIKPRELYLLFRPFKGYEGSLIKLTSKQPVGFVSFDSRSEAEAAKNALNGIRFDPEIPQTLRLEFAKANTKMAKNKLVGTPNPSTPLPNTVPQFIAREPYELTVPALYPSSPEVWAPYPLYPAELAPALPPPAFTYPASLHAQMRWLPPSEATSQGWKSRQFC

SEQ ID NO: 1270 - protein, 291 aa, Homo sapiens
MDPSLLRERELFKKRALSTPVVEKRSASSESSSSSSKKKKTKVEHGGSSGSKQNSDHSNGSFNLKALSGSSGYKFGVLAKIVNYMKTRHQRGDTHPLTLDEILDETQHLDIGLKQKQWLMTEALVNNPKIEVIDGKYAFKPKYNVRDKKALLRLLDQHDQRGLGGILLEDIEEALPNSQKAVKALGDQILFVNRPDKKKILFFNDKSCQFSVDEEFQKLWRSVTVDSMDEEKIEEYLKRQGISSMQESGPKKVAPIQRRKKPASQKKRRFKTHNEHLAGVLKDYSDITSSK

SEQ ID NO: 1271 - protein, 479 aa, Homo sapiens
MACRQEPQPQGPPPAAGAVASYDYLVIGGGSGGLASARRAAELGARAAVVESHKLGGTCVNVGCVPKKVMWNTAVHSEFMHDHADYGFPSCEGKFNWRVIKEKRDAYVSRLNAIYQNNLTKSHIEIIRGHAAFTSDPKPTIEVSGKKYTAPHILIATGGMPSTPHESQIPGASLGITSDGFFQLEELPGRSVIVGAGYIAVEMAGILSALGSKTSLMIRHDKVLRSFDSMISTNCTEELENAGVEVLKFSQVKEVKKTLSGLEVSMVTAVPGRLPVMTMIPDVDCLLWAIGRVPNTKDLSLNKLGIQTDDKGHIIVDEFQNTNVKGIYAVGDVCGKALLTPVAIAAGRKLAHRLFEYKEDSKLDYNNIPTVVFSHPPIGTVGLTEDEAIHKYGIENVKTYSTSFTPMYHAVTKRKTKCVMKMVCANKEEKVVGIHMQGLGCDEMLQGFAVAVKMGATKADFDNTVAIHPTSSEELVTLR

SEQ ID NO: 1272 - protein, 270 aa, Homo sapiens
MASRGVVGIFFLSAVPLVCLELRRGIPDIGIKDFLLLCGRILLLLALLTLIISVTTSWLNSFKSPQVYLKEEEEKNEKRQKLVRKKQQEAQGEKASRYIENVLKPHQEMKLRKLEERFYQMTGEAWKLSSGHKLGGDEGTSQTSFETSNREAAKSQNLPKPLTEFPSPAEQPTCKEIPDLPEEPSQTAEEVVTVALRCPSGNVLRRRFLKSYSSQVLFDWMTRIGYHISLYSLSTSFPRRPLAVEGGQSLEDIGITVDTVLILEEKEQTN

SEQ ID NO: 1273 - protein, 309 aa, Homo sapiens
MDDKAFTKELDQWVEQLNECKQLNENQVRTLCEKAKEILTKESNVQEVRCPVTVCGDVHGQFHDLMELFRIGGKSPDTNYLFMGDYVDRGYYSVETVTLLVALKVRYPERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 1274 - protein, 211 aa, Homo sapiens
MSERKEGRGKGKGKKKERGSGKKPESAAGSQSPALPPQLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCK

SEQ ID NO: 1275 - protein, 645 aa, Homo sapiens
MSERKEGRGKGKGKKKERGSGKKPESAAGSQSPALPPQLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 1276 - protein, 637 aa, Homo sapiens
MSERKEGRGKGKGKKKERGSGKKPESAAGSQSPALPPQLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSKPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 1277 - protein, 241 aa, Homo sapiens
MSERKEGRGKGKGKKKERGSGKKPESAAGSQSPALPPQLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYSTSTPFLSLPE

SEQ ID NO: 1278 - protein, 296 aa, Homo sapiens
MEIYSPDMSEVAAERSSSPSTQLSADPSLDGLPAAEDMPEPQTEDGRTPGLVGLAVPCCACLEAERLRGCLNSEKICIVPILACLVSLCLCIAGLKWVFVDKIFEYDSPTHLDPGGLGQDPIISLDATAASAVWVSSEAYTSPVSRAQSESEVQVTVQGDKAVVSFEPSAAPTPKNRIFAFSFLPSTAPSFPSPTRNPEVRTPKSATQPQTTETNLQTAPKLSTSTSTTGTSHLVKCAEKEKTFCVNGGECFMVKDLSNPSRYLCKCPNEFTGDRCQNYVMASFYSTSTPFLSLPE

SEQ ID NO: 1279 - protein, 462 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRSSSIPHLGFIL

SEQ ID NO: 1280 - protein, 241 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYSTSTPFLSLPE

SEQ ID NO: 1281 - protein, 422 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPQLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYSTSTPFLSLPE

SEQ ID NO: 1282 - protein, 640 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 1283 - protein, 300 aa, Homo sapiens
MQSDDVIWDTLGNKQFCSFKIRTKTQSFCRNEYSLTGLCNRSSCPLANSQYATIKEEKGQCYLYMKVIERAAFPRRLWERVRLSKNYEKALEQIDENLIYWPRFIRHKCKQRFTKITQYLIRIRKLTLKRQRKLVPLSKKVERREKRREEKALIAAQLDNAIEKELLERLKQDTYGDIYNFPIHAFDKALEQQEAESDSSDTEEKDDDDDDEEDVGKREFVEDGEVDESDISDFEDMDKLDASSDEDQDGKSSSEEEEEKALSAKHKGKMPLRGPLQRKRAYVEIEYEQETEPVAKAKTT

SEQ ID NO: 1284 - protein, 508 aa, Homo sapiens
MELDSALEAPSQEDSNLSEELSHSAFGQAFSKILHCLARPEARRGNVKDAVLKDLGDLIEATGFDRLFEGTGARLRGMPETLGQVAKALEKYAAPSKEEEGGGDGHSEAAEKAAQVGLLFLKLLGKVETAKNSLVGPAWQTGLHHLAGPVYIFAITHSLEQPWTTPRSREVAREVLTSLLQVTECGSVAGFLHGENEDEKGRLSVILGLLKPDLYKESWKNNPAIKHVFSWTLQQVTRPWLSQHLERVLPASLVISDDYQTENKILGVHCLHHIVLNVPAADLLQYNRAQVLYHAISNHLYTPEHHLIQAVLLCLLDLFPILEKTLHWKGDGARPTTHCDEVLRLILTHMEPEHRLLLRRTYARNLPAFVNRLGILTVRHLKRLERVIIGYLEVYDGPEEEARLKILETLKLLMQHTWPRVSCRLVVLLKALLKLICDVARDPNLTPESVKSALLQEATDCLILLDRRSQGRVKGLLAKIPQSCEDRKVVNYIRKVQQVSEGAPYNGT

SEQ ID NO: 1285 - protein, 339 aa, Homo sapiens
MAQLGAVVAVASSFFCASLFSAVHKIEEGHIGVYYRGGALLTSTSGPGFHLMLPFITSYKSVQTTLQTDEVKNVPCGTSGGVMIYFDRIEVVNFLVPNAVYDIVKNYTADYDKALIFNKIHHELNQFCSVHTLQEVYIELFDQIDENLKLALQQDLTSMAPGLVIQAVRVTKPNIPEAIRRNYELMESEKTKLLIAAQKQKVVEKEAETERKKALIEAEKVAQVAEITYGQKVMEKETEKKISEIEDAAFLAREKAKADAECYTAMKIAEANKLKLTPEYLQLMKYKAIASNSKIYFGKDIPNMFMDSAGSVSKQFEGLADKLSFGLEDEPLETATKEN

SEQ ID NO: 1286 - protein, 275 aa, Homo sapiens
MWRAGSMSAELGVGCALRAVNERVQQAVARRPRDLPAIQPRLVAVSKTKPADMVIEAYGHGQRTFGENYVQELLEKASNPKILSLCPEIKWHFIGHLQKQNVNKLMAVPNLFMLETVDSVKLADKVNSSWQRKGSPERLKVMVQINTSGEESKHGLPPSETIAIVEHINAKCPNLEFVGLMTIGSFGHDLSQGPNPDFQLLLSLREELCKKLNIPADQVELSMGMSADFQHAVEVGSTNVRIGSTIFGERDYSKKPTPDKCAADVKAPLEVAQEH

SEQ ID NO: 1287 - protein, 1586 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 1288 - protein, 1568 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 1289 - protein, 873 aa, Homo sapiens
MGTSALWAVWLLLALCWAPRESGATGTGRKAKCEPSQFQCTNGRCITLLWKCDGDEDCVDGSDEKNCVKKTCAESDFVCNNGQCVPSRWKCDGDPDCEDGSDESPEQCHMRTCRIHEISCGAHSTQCIPVSWRCDGENDCDSGEDEENCGNITCSPDEFTCSSGRCISRNFVCNGQDDCSDGSDELDCAPPTCGAHEFQCSTSSCIPISWVCDDDADCSDQSDESLEQCGRQPVIHTKCPASEIQCGSGECIHKKWRCDGDPDCKDGSDEVNCPSRTCRPDQFECEDGSCIHGSRQCNGIRDCVDGSDEVNCKNVNQCLGPGKFKCRSGECIDISKVCNQEQDCRDWSDEPLKECHINECLVNNGGCSHICKDLVIGYECDCAAGFELIDRKTCGDIDECQNPGICSQICINLKGGYKCECSRAYQMDLATGVCKAVGKEPSLIFTNRRDIRKIGLERKEYIQLVEQLRNTVALDADIAAQKLFWADLSQKAIFSASIDDKVGRHVKMIDNVYNPAAIAVDWVYKTIYWTDAASKTISVATLDGTKRKFLFNSDLREPASIAVDPLSGFVYWSDWGEPAKIEKAGMNGFDRRPLVTADIQWPNGITLDLIKSRLYWLDSKLHMLSSVDLNGQDRRIVLKSLEFLAHPLALTIFEDRVYWIDGENEAVYGANKFTGSEHATLVNNLNDAQDIIVYHELVQPSGKNWCEEDMENGGCEYLCLPAPQINDHSPKYTCSCPSGYNVEENGRDCQSTATTVTYSETKDTNTTEISATSGLVPGGINVTTAVSEVSVPPKGTSAAWAILPLLLLVMAAVGGYLMWRNWQHKNMKSMNFDNPVYLKTTEEDLSIDIGRHSASVGHTYPAISVVSTDDDLA

SEQ ID NO: 1290 - protein, 508 aa, Homo sapiens
MWEILRRKDCDKEKRVKLMSDLQKLIQGKIKTIAFAHDSTRVIQCYIQYGNEEQRKQAFEELRDDLVELSKAKYSRNIVKKFLMYGSKPQIAEIIRSFKGHVRKMLRHAEASAIVEYAYNDKAILEQRNMLTEELYGNTFQLYKSADHRTLDKVLEVQPEKLELIMDEMKQILTPMAQKEAVIKHSLVHKVFLDFFTYAPPKLRSEMIEAIREAVVYLAHTHDGARVAMHCLWHGTPKDRKVIVKTMKTYVEKVANGQYSHLVLLAAFDCIDDTKLVKQIIISEIISSLPSIVNDKYGRKVLLYLLSPRDPAHTVREIIEVLQKGDGNAHSKKDTEVRRRELLESISPALLSYLQEHAQEVVLDKSACVLVSDILGSATGDVQPTMNAIASLAATGLHPGGKDGELHIAEHPAGHLVLKWLIEQDKKMKENGREGCFAKTLVEHVGMKNLKSWASVNRGAIILSSLLQSCDLEVANKVKAALKSLIPTLEKTKSTSKGIEILLEKLST

SEQ ID NO: 1291 - protein, 147 aa, Homo sapiens
MGFIFSKSMNESMKNQKEFMLMNARLQLERQLIMQSEMRERQMAMRIAWSREFLKYFGTFFGLAAISLTAGAIKKKKPAFLVPIVPLSFILTYQYDLGYGTLLERMKGEAEDILETEKSKLQLPRGMITFESIEKARKEQSRFFIDK

SEQ ID NO: 1292 - protein, 273 aa, Homo sapiens
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPSCIIAFIFIATVIALRKQLCQKLYSSKDTTKRPVTTTKREVNSAI

SEQ ID NO: 1293 - protein, 420 aa, Homo sapiens
MMYSPICLTQDEFHPFMEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQSWYLG

SEQ ID NO: 1294 - protein, 420 aa, Homo sapiens; identical to SEQ ID NO: 1293

SEQ ID NO: 1295 - protein, 411 aa, Homo sapiens
MAEGSRGGPTCSGVGGRQDPVSGSGGCNFPEYELPELNTRAFHVGAFGELWRGRLRGAGDLSLREPPASALPGSQAADSDREDAAVARDLDCSLEAAAELRAVCGLDKLKCLEDGEDPEVIPENTDLVTLGVRKRFLEHREETITIDRACRQETFVYEMESHAIGKKPENSADMIEEGELILSVNILYPVIFHKHKEHKPYQTMLVLGSQKLTQLRDSIRCVSDLQIGGEFSNTPDQAPEHISKDLYKSAFFYFEGTFYNDKRYPECRDLSRTIIEWSESHDRGYGKFQTARMEDFTFNDLCIKLGFPYLYCHQGDCEHVIVITDIRLVHHDDCLDRTLYPLLIKKHWLWTRKCFVCKMYTARWVTNNDSFAPEDPCFFCDVCFRMLHYDSEGNKLGEFLAYPYVDPGTFN

SEQ ID NO: 1296 - protein, 333 aa, Homo sapiens
MTRDFKPGDLIFAKMKGYPHWPARVDEVPDGAVKPPTNKLPIFFFGTHETAFLGPKDIFPYSENKEKYGKPNKRKGFNEGLWEIDNNPKVKFSSQQAATKQSNASSDVEVEEKETSVSKEDTDHEEKASNEDVTKAVDITTPKAARRGRKRKAEKQVETEEAGVVTTATASVNLKVSPKRGRPAATEVKIPKPRGRPKMVKQPCPSESDIITEEDKSKKKGQEGKQPKKQPKKDEEGQKEEDKPRKEPDKKEGKKEVESKRKNLAKTGVTSTSDSEEEGDDQEGEKKRKGGRNFQTAHRRNMLKGQHEKEAADRKRKQEEQMETEHQTTCNLQ

SEQ ID NO: 1297 - protein, 530 aa, Homo sapiens
MTRDFKPGDLIFAKMKGYPHWPARVDEVPDGAVKPPTNKLPIFFFGTHETAFLGPKDIFPYSENKEKYGKPNKRKGFNEGLWEIDNNPKVKFSSQQAATKQSNASSDVEVEEKETSVSKEDTDHEEKASNEDVTKAVDITTPKAARRGRKRKAEKQVETEEAGVVTTATASVNLKVSPKRGRPAATEVKIPKPRGRPKMVKQPCPSESDIITEEDKSKKKGQEEKQPKKQPKKDEEGQKEEDKPRKEPDKKEGKKEVESKRKNLAKTGVTSTSDSEEEGDDQEGEKKRKGGRNFQTAHRRNMLKGQHEKEAADRKRKQEEQMETEQQNKDEGKKPEVKKVEKKRETSMDSRLQRIHAEIKNSLKIDNLDVNRCIEALDELASLQVTMQQAQKHTEMITTLKKIRRFKVSQVIMEKSTMLYNKFKNMFLVGEGDSVITQVLNKSLAEQRQHEEANKTKDQGKKGPNKKLEKEQTGSKTLNGGSDAQDGNQPQHNGESNEDSKDNHEASTKKKPSSEERETEISLKDSTLDN

SEQ ID NO: 1298 - protein, 313 aa, Homo sapiens
MPNTAMKKKVLLMGKSGSGKTSMRSIIFANYIARDTRRLGATIDVEHSHVRFLGNLVLNLWDCGGQDTFMENYFTSQRDNIFRNVEVLIYVFDVESRELEKDMHYYQSCLEAILQNSPDAKIFCLVHKMDLVQEDQRDLIFKEREEDLRRLSRPLECACFRTSIWDETLYKAWSSIVYQLIPNVQQLEMNLRNFAQIIEADEVLLFERATFLVISHYQCKEQRDVHRFEKISNIIKQFKLSCSKLAASFQSMEVRNSNFAAFIDIFTSNTYVMVVMSDPSIPSAATLINIRNARKHFEKLERVDGPKHSLLMR

SEQ ID NO: 1299 - protein, 955 aa, Homo sapiens
MSSASVTAFEKEHLWMYLQALGFEPGPATIACGKIVSHTHLGVNMFDKLNRDAFHIISYFLFQVLDQSLTKEVFKFCWPPFDQKSDTEFRKHCCEWIKRISGECGSSFPQVVGSLFLSPGGPKFIHLMYHFARFVAMKYIKSNSKNSSHHFVETFNIKPQDLHKCIARCHFARSRFLQILQRQDCVTQKYQENAQLSVKQVRNLRSECIGLENQIKKMEPYDDHSNMEEKIQKVRSLWASVNETLMFLEKEREVVSSVLSLVNQYALDGTNVAINIPRLLLDKIEKQMFQLHIGNVYEAGKLNLLTVIQLLNEVLKVMKYERCQADQARLTVDLHYLEKETKFQKERLSDLKHMRYRIKDDLTTIRHSVVEKQGEWHKKWKEFLGLSPFSLIKGWTPSVDLLPPMSPLSFDPASEEVYAKSILCQYPASLPDAHKQHNQENGCRGDSDTLGALHDLANSPASFLSQSVSSSDRNSVTVLEKDTKMGTPKEKNEAISKKIPEFEVENSPLSDVAKNTESSAFGGSLPAKKSDPFQKEQDHLVEEVARAVLSDSPQLSEGKEIKLEELIDSLGSNPFLTRNQIPRTPENLITEIRSSWRKAIEMEENRTKEPIQMDAEHREVLPESLPVLHNQREFSMADFLLETTVSDFGQSHLTEEKVISDCECVPQKHVLTSHIDEPPTQNQSDLLNKKVICKQDLECLAFTKLSETSRMETFSPAVGNRIDVMGGSEEEFMKILDHLEVSCNKPSTNKTMLWNSFQISSGISSKSFKDNDFGILHETLPEEVGHLSFNSSSSSEANFKLEPNSPMHGGTLLEDVVGGRQTTPESDFNLQALRSRYEALKKSLSKKREESYLSNSQTPERHKPELSPTPQNVQTDDTLNFLDTCDLHTEHIKPSLRTSIGERKRSLSPLIKFSPVEQRLRTTIACSLGELPNLKEEDILNKSLDAKEPPSDLTR

SEQ ID NO: 1300 - protein, 249 aa, Homo sapiens
MKLNISFPATGCQKLIEVDDERKLRTFYEKRMATEVAADALGEEWKGYVVRISGGNDKQGFPMKQGVLTHGRVRLLLSKGHSCYRPRRTGERKRKSVRGCIVDANLSVLNLVIVKKGEKDIPGLTDTTVPRRLGPKRASRIRKLFNLSKEDDVRQYVVRKPLNKEGKKPRTKAPKIQRLVTPRVLQHKRRRIALKKQRTKKNKEEAAEYAKLLAKRMKEAKEKRQEQIAKRRRLSSLRASTSKSESSQK

SEQ ID NO: 1301 - protein, 1801 aa, Homo sapiens
MSDDIRKRFEFPNSLIQSQAVGHLIAAVLKENGFSEKIHQSTNQTPALNLLWEKCCSDNVVVRTACCEGLVALVAQDHAEFSYVLNGILNLIPSTRNTHGLIKAIMHLLQMQALKEGQGGEKNIQSIYTIRNHPHPLITVLEHRPDCWPVFLQQLTAFFQQCPERLEVSCIQIMAPFLWYLYCEPSQLQEYAKLRLALLKVLLQPQVLCDKDQPSILEQQILQLCCDIVPCLQVKDLIQTTEAMMFIEEVCLSLLRHPVFWKIQLTQMSLQLLCVSEVSLKITGECSSSIHLLEHSVELLKEDFPVELVIIGIALLLLQTPASQQKPILNLALKLLSVTEDQKIPKSSLLLVMPILQILSSTALEDCISVDEEGPSRQQLALNLLEMIQQECYRDDHQKLSYKLVCPVTSMYGTIFTAWRILEVMTDSSAASDWLASVESLLPITAVIPAPAFLLLAHLLVEDKGQNLHQILKVTTELAQVDSSQVPNLIPVLMFKLGRPLEPILYNDILYTLPKLGVHKVCIGQILRIIQLLGTTPRLRAVTLRLLTSLWEKQDRVYPELQRFMAVSDVPSLSVGKEVQWEKLIAKAASIRDICKQRPYQHGADMLAAISQVLNECTKPDQATPAALVLQGLHALCQAEVVCIRSTWNALSPKLSCDTRPLILKTLSELFSLVPSLTVNTTEYENFKVQVLSFLWTHTQNKDPIVANAAYRSLANFSAGEHTILHLPEKIRPEIPIPEELDDDEDVEDVDLSVPGSCYLKLLSLTPPLVLPALEEFFTSLVKQEMVNMPRGIYHSALKGGARSDQGKTVAGIPNFILKMYETNKQPGLKPGLAGGMLFCYDVSMYQSKDGKPLNRLMASRGRSFKQTSLALVHEVHIQLSEWHRAIFLPQAWLAYMNRAYHAILQGRLGELELQLKHGKEEPEEVQYKKSTAWLWVRDMLTDEITKAAAKESPVVKGNALLALSSLAVVVSRHEASLSSDSDGLLEVQPNFLSMKEWVSMVLDTLLVIVDSHYQPRGQLLSWFYYKSYSGENTASAIARSAAATALSLLVPVFIISCKEKVEEILNMLTARLPGKPSADESQAVQIHMGLALGMFLSRLCEEKLSDISGQEMNLLLMKSLDALENCCFDTSLEYNTGCILGVGLVLSLMSHSSQMQSRVHVAALLRKLSAHVDDSGSQSRTFQEVLAYTLSCVCTSAFSAGIIEATEAEDVMNKLRLLVENSQQTSGFALALGNIVHGLSVCGHGKAEDLGSKLLPAWIRIVLTEGTPTMLCLAALHGMVALVGSEGDVMQLKSEAIQTSHFQGRLNEVIRTLTQVISVSGVIGLQSNAVWLLGHLHLSTLSSSQSRASVPTDYSYLPESSFIGAAIGFFITGGKKGPESVPPSLLKVVMKPIATVGESYQYPPVNWAALLSPLMRLNFGEEIQQLCLEIMVTQAQSSQNAAALLGLWVTPPLIHSLSLNTKRYLLISAPLWIKHISDEQILGFVENLMVAVFKAASPLGSPELCPSALHGLSQAMKLPSPAHHLWSLLSEATGKIFDLLPNKIRRKDLELYISIAKCLLEMTDDDANRIAQVTKSNIEKAAFVKLYLVSQGRFPLVNLTDMLSVAVQHREKEVLAWMILHSLYQARIVSHANTGVLKRMEWLLELMGYIRNVAYQSTSFHNTALDEALDFFLLIFATAVVAWADHTAPLLLGLSASWLPWHQENGPAGPVPSFLGRSPMHRVTLQEVLTLLPNSMALLLQKEPWKEQTQKFIDWLFSIMESPKEALSAQSRDLLKATLLSLRVLPEFKKKAVWTRAYGW

SEQ ID NO: 1302 - protein, 617 aa, Homo sapiens
MKVSLGNGEMGVSAHLQPCKAGTTRFFTSNTHSSVVLQGFDQLRIEGLLCDVTLVPGDGDEIFPVHRAMMASASDYFKAMFTGGMKEQDLMCIKLHGVNKVGLKKIIDFIYTAKLSLNMDNLQDTLEAASFLQILPVLDFCKVFLISGVSLDNCVEVGRIANTYNLIEVDKYVNNFILKNFPALLSTGEFLKLPFERLAFVLSSNSLKHCTELELFKAACRWLRLEDPRMDYAAKLMKNIRFPLMTPQDLINYVQTVDFMRTDNTCVNLLLEASNYQMMPYMQPVMQSDRTAIRSDSTHLVTLGGVLRQQLVVSKELRMYDERAQEWRSLAPMDAPRYQHGIAVIGNFLYVVGGQSNYDTKGKTAVDTVFRFDPRYNKWMQVASLNEKRTFFHLSALKGHLYAVGGRSAAGELATVECYNPRMNEWSYVAKMSEPHYGHAGTVYGGLMYISGGITHDTFQNELMCFDPDTDKWMQKAPMTTVRGLHCMCTVGDKLYVIGGNHFRGTSDYDDVLSCEYYSPTLDQWTPIAAMLRGQSDVGVAVFENKIYVVGGYSWNNRCMVEIVQKYDPEKDEWHKVFDLPESLGGIRACTLTVFPPEENPGSPSRESPLSAPSDHS

SEQ ID NO: 1303 - protein, 283 aa, Homo sapiens
MASGTTTTAVKIGIIGGTGLDDPEILEGRTEKYVDTPFGKPSDALILGKIKNVDCILLARHGRQHTIMPSKVNYQANIWALKEEGCTHVIVTTACGSLREEIQPGDIVIIDQFIDRTTMRPQSFYDGSHSCARGVCHIPMAEPFCPKTREVLIETAKKLGLRCHSKGTMVTIEGPRFSSRAESFMFRTWGADVINMTTVPEVVLAKEAGICYASIAMATDYDCWKEHEEAVSVDRVLKTLKENANKAKSLLLTTIPQIGSTEWSETLHNLKNMAQFSVLLPRH

SEQ ID NO: 1304 - protein, 156 aa, Homo sapiens
MEPAAGSSMEPSADWLATAAARGRVEEVRALLEAGALPNAPNSYGRRPIQVMMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSDIPD

SEQ ID NO: 1305 - protein, 173 aa, Homo sapiens
MGRGRCVGPSLQLRGQEWRCSPLVPKGGAAAAELGPGGGENMVRRFLVTLRIRRACGPPRVRVFVVHIPRLTGEWAAPGAPAAVALVLMLLRSQRLGQQPLPRRPGHDDGQRPSGGAAAAPRRGAQLRRPRHSHPTRARRCPGGLPGHAGGAAPGRGAAGRARCLGPSARGPG

SEQ ID NO: 1306 - protein, 116 aa, Homo sapiens
MEPAAGSSMEPSADWLATAAARGRVEEVRALLEAGALPNAPNSYGRRPIQVGRRSAAGAGDGGRLWRTKFAGELESGSASILRKKGRLPGEFSEGVCNHRPPPGDALGAWETKEEE

SEQ ID NO: 1307 - protein, 283 aa, Homo sapiens; identical to SEQ ID NO: 1303

SEQ ID NO: 1308 - protein, 384 aa, Homo sapiens
MTRRGRRRSSHFLGPPAGAAGCTQRRSRELAAAAMSHQTGIQASEDVKEIFARARNGKYRLLKISIENEQLVIGSYSQPSDSWDKDYDSFVLPLLEDKQPCYILFRLDSQNAQGYEWIFIAWSPDHSHVRQKMLYAATRATLKKEFGGGHIKDEVFGTVKEDVSLHGYKKYLLSQSSPAPLTAAEEELRQIKINEVQTDVGVDTKHQTLQGVAFPISREAFQALEKLNNRQLNYVQLEIDIKNEIIILANTTNTELKDLPKRIPKDSARYHFFLYKHSHEGDYLESIVFIYSMPGYTCSIRERMLYSSCKSRLLEIVERQLQMDVIRKIEIDNGDELTADFLYEEVHPKQHAHKQSFAKPKGPAGKRGIRRLIRGPAETEATTD

SEQ ID NO: 1309 - protein, 252 aa, Homo sapiens
MLYAATRATLKKEFGGGHIKDEVFGTVKEDVSLHGYKKYLLSQSSPAPLTAAEEELRQIKINEVQTDVGVDTKHQTLQGVAFPISREAFQALEKLNNRQLNYVQLEIDIKNEIIILANTTNTELKDLPKRIPKDSARYHFFLYKHSHEGDYLESIVFIYSMPGYTCSIRERMLYSSCKSRLLEIVERQLQMDVIRKIEIDNGDELTADFLYEEVHPKQHAHKQSFAKPKGPAGKRGIRRLIRGPAETEATTD

SEQ ID NO: 1310 - protein, 391 aa, Homo sapiens
MSELRLCCDLLVQQVDKTKEVTTTGVSNSEEGIDVGTLLKSTCNTFLKTLEECMQIANAAFTSELLYHTPPGSPQLAMLKSSKMKHPIIPIHNSLERQTELSTCENGSLNMEINGEEEILMKNKNSLYLKSAEIDCSISSEENTDDNITVQGEIMKEDRMENLKNHDNNLSQSGSDSSCSPECLWEEGKEVIPTFFSTMNTSFSDIELLEDSGIPTEAFLASCCAVVPVLDKLGPTVFAPVKMDLVENIKKVNQKYITNKEEFTTLQKIVLHEVEADVAQVRNSATEALLWLKRGLKFLKGFLTEVKNGEKDIQTALNNAYGKTLRQHHGWVVRGVFALALRATPSYEDFVAALTVKEGDHRKEAFSIGMQRDLSLYLPAMKKQMAILDAL

SEQ ID NO: 1311 - protein, 1148 aa, Homo sapiens
MTTPTRRSTRNTRAETASQSQRSPISDNSGCDAPGNSNPSLSVPSSAESEKQTRQAPKRKSVRRGRKPPLLKKKLRSSVAAPEKSSSNDSVDEETAESDTSPVLEKEHQPDVDSSNICTVQTHVENQSANCLKSCNEQIEESEKHTANYDTEERVGSSSSESCAQDLPVLVGEEGEVKKLENTGIEANVLCLESEISENILEKGGDPLEKQDQISGLSQSEVKTDVCTVHLPNDFPTCLTSESKVYQPVSCPLSDLSENVESVVNEEKITESSLVEITEHKDFTLKTEELIESPKLESSEGEIIQTVDRQSVKSPEVQLLGHVETEDVEIIATCDTFGNEDFNNIQDSENNLLKNNLLNTKLEKSLEEKNESLTEHPRSTELPKTHIEQIQKHFSEDNNEMIPMECDSFCSDQNESEVEPSVNADLKQMNENSVTHCSENNMPSSDLADEKVETVSQPSESPKDTIDKTKKPRTRRSRFHSPSTTWSPNKDTPQEKKRPQSPSPRRETGKESRKSQSPSPKNESARGRKKSRSQSPKKDIARERRQSQSRSPKRDTTRESRRSESLSPRRETSRENKRSQPRVKDSSPGEKSRSQSRERESDRDGQRRERERRTRKWSRSRSHSRSPSRCRTKSKSSSFGRIDRDSYSPRWKGRWANDGWRCPRGNDRYRKNDPEKQNENTRKEKNDIHLDADDPNSADKHRNDCPNWITEKINSGPDPRTRNPEKLKESHWEENRNENSGNSWNKNFGSGWVSNRGRGRGNRGRGTYRSSFAYKDQNENRWQNRKPLSGNSNSSGSESFKFVEQQSYKRKSEQEFSFDTPADRSGWTSASSWAVRKTLPADVQNYYSRRGRNSSGPQSGWMKQEEETSGQDSSLKDQTNQQVDGSQLPINMMQPQMNVMQQQMNAQHQPMNIFPYPVGVHAPLMNIQRNPFNIHPQLPLHLHTGVPLMQVATPTSVSQGLPPPPPPPPPSQQVNYIASQPDGKQLQGIPSSSHVSNNMSTPVLPAPTAAPGNTGMVQGPSSGNTSSSSHSKASNAAVKLAESKVSVAVEASADSSKTDKKLQIQEKAAQEVKLAIKPFYQNKDITKEEYKEIVRKAVDKVCHSKSGEVNSTKVANLVKAYVDKYKYSRKGSQKKTLEEPVSTEKNIG

SEQ ID NO: 1312 - protein, 239 aa, Homo sapiens
MPTATGLTLLTSASSAISDPGGEVSAPWGGLRTWTQPLRCWERLLPPPGDPRTVAENTQQDECGLPGSCPARPLSRKPECGREGILPCCSSSAWPEGSFRPFQMNLFSFLSFFFLFFFFLRWSLTLSPRLECSSAISAHCNLRLPGSSNSPALASQVAGITGICHHARQIFVFLVETGFCHVGQAGLELLISGDSPASAFQSAGIIGVSHRARPGSVFLARSEESLYLRPGQQSQEVKV

SEQ ID NO: 1313 - protein, 427 aa, Homo sapiens
MEAMAASTSLPDPGDFDRNVPRICGVCGDRATGFHFNAMTCEGCKGFFRRSMKRKALFTCPFNGDCRITKDNRRHCQACRLKRCVDIGMMKEFILTDEEVQRKREMILKRKEEEALKDSLRPKLSEEQQRIIAILLDAHHKTYDPTYSDFCQFRPPVRVNDGGGSHPSRPNSRHTPSFSGDSSSSCSDHCITSSDMMDSSSFSNLDLSEEDSDDPSVTLELSQLSMLPHLADLVSYSIQKVIGFAKMIPGFRDLTSEDQIVLLKSSAIEVIMLRSNESFTMDDMSWTCGNQDYKYRVSDVTKAGHSLELIEPLIKFQVGLKKLNLHEEEHVLLMAICIVSPDRPGVQDAALIEAIQDRLSNTLQTYIRCRHPPPGSHLLYAKMIQKLADLRSLNEEHSKQYRCLSFQPECSMKLTPLVLEVFGNEIS

SEQ ID NO: 1314 - protein, 390 aa, Homo sapiens
MKKTNPGPVGETLLCQLSSYAKTELGSQTPESSRSEASRILDEDSWSDGEQEPITVDQTWRGDPDSEADSIDSDQEDPLKHAGVYTAEEVALIMREKLIRLQSLYIDQFKRLQHLLKEKKRRYLHNRKVEHEALGSSLLTGPEGLLAKERENLKRLKCLRRYRQRYGVEALLHRQLKERRMLATDGAAQQAHTTRSSQRCLAFVDDVRCSNQSLPMTRHCLTHICQDTNQVLFKCCQGSEEVPCNKPVPVSLSEDPCCPLHFQLPPQMYKPEQVLSVPDDLEAGPMDLYLSAAELQPTESLPLEFSDDLDVVGDGMQCPPSPLLFDPSLTLEDHLVKEIAEDTVDILGQMQMAGDGCRSQGSRNSEKASAPLSQSGLATANGKPEPTSIS

SEQ ID NO: 1315 - protein, 484 aa, Homo sapiens
MYDDSYVPGFEDSEAGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 1316 - protein, 484 aa, Homo sapiens; identical to SEQ ID NO: 1315

SEQ ID NO: 1317 - protein, 820 aa, Homo sapiens
MAGELADKKDRDASPSKEERKRSRTPDRERDRDRDRKSSPSKDRKRHRSRDRRRGGSRSRSRSRSKSAERERRHKERERDKERDRNKKDRDRDKDGHRRDKDRKRSSLSPGRGKDFKSRKDRDSKKDEEDEHGDKKPKAQPLSLEELLAKKKAEEEAEAKPKFLSKAEREAEALKRRQQEVEERQRMLEEERKKRKQFQDLGRKMLEDPQERERRERRERMERETNGNEDEEGRQKIREEKDKSKELHAIKERYLGGIKKRRRTRHLNDRKFVFEWDASEDTSIDYNPLYKERHQVQLLGRGFIAGIDLKQQKREQSRFYGDLMEKRRTLEEKEQEEARLRKLRKKEAKQRWDDRHWSQKKLDEMTDRDWRIFREDYSITTKGGKIPNPIRSWKDSSLPPHILEVIDKCGYKEPTPIQRQAIPIGLQNRDIIGVAETGSGKTAAFLIPLLVWITTLPKIDRIEESDQGPYAIILAPTRELAQQIEEETIKFGKPLGIRTVAVIGGISREDQGFRLRMGCEIVIATPGRLIDVLENRYLVLSRCTYVVLDEADRMIDMGFEPDVQKILEHMPVSNQKPDTDEAEDPEKMLANFESGKHKYRQTVMFTATMPPAVERLARSYLRRPAVVYIGSAGKPHERVEQKVFLMSESEKRKKLLAILEQGFDPPIIIFVNQKKGCDVLAKSLEKMGYNACTLHGGKGQEQREFALSNLKAGAKDILVATDVAGRGIDIQDVSMVVNYDMAKNIEDYIHRIGRTGRAGKSGVAITFLTKEDSAVFYELKQAILESPVSSCPPELANHPDAQHKPGTILTKKRREETIFA

SEQ ID NO: 1318 - protein, 201 aa, Homo sapiens
MTLRPSLLPLHLLLLLLLSAAVCRAEAGLETESPVRTLQVETLVEPPEPCAEPAAFGDTLHIHYTGSLVDGRIIDTSLTRDPLVIELGQKQVIPGLEQSLLDMCVGEKRRAIIPSHLAYGKRGFPPSVPADAVVQYDVELIALIRANYWLKLVKGILPLVGMAMVPALLGLIGYHLYRKANRPKVSKKKLKEEKRNKSKKK

SEQ ID NO: 1319 - protein, 181 aa, Homo sapiens
MGNIFGNLLKSLIGKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLANQLKNKK

SEQ ID NO: 1320 - protein, 181 aa, Homo sapiens; identical to SEQ ID NO: 1319

SEQ ID NO: 1321 - protein, 331 aa, Homo sapiens
METVISSDSSPAVENEHPQETPESNNSVYTSFMKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 1322 - protein, 484 aa, Homo sapiens
MVNVKALCEPEVSNCWMNVITGTGSVSSPLLVLPQPGPETSLMTGEPVDDEDATVNKIALELCTFTLAIALGAVLLLPFSIISNEVLLSLPRNYYIQWLNGSLIHGLWNLVFLFSNLSLIFLMPFAYFFTESEGFAGSRKGVLGRVYETVVTLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRICNPTSCWLPLDMELLHRQVLALQTQRVLLEKRRKASAWQRNLGYPLAMLCLLVLTGLSVLIVAIHILELLIDEAAMPRVMQGTSLGQVSFSKLGSFGAVIQVVLIFYLMVSSVVGFYSSPLFRSLRPRWHDTAMTQIIGNCVCLLVLSSALPVFSRTLGLTRFDLLGDFGRFNWLGNFYIVFLYNAAFAGLTTLCLVKTFTAAVRAELIRAFGLDRLPLPVSGFPQASRKTQHQ

SEQ ID NO: 1323 - protein, 545 aa, Homo sapiens
MSRKQNQKDSSGFIFDLQSNTVLAQGGAFENMKEKINAVRAIVPNKSNNEIILVLQHFDNCVDKTVQAFMEGSASEVLKEWTVTGKKKNKKKKNKPKPAAEPSNGIPDSSKSVSIQEEQSAPSSEKGGMNGYHVNGAINDTESVDSLSEGLETLSIDARELEDPESAMLDTLDRTGSMLQNGVSDFETKSLTMHSIHNSQQPRNAAKSLSRPTTETQFSNMGMEDVPLATSKKLSSNIEKSVKDLQRCTVSLARYRVVVKEEMDASIKKMKQAFAELESCLMDREVALLAEMDKVKAEAMEILLSRQKKAELLKKMTHVAVQMSEQQLVELRADIKHFVSERKYDEDLGRVARFTCDVETLKKSIDSFGQVSHPKNSYSTRSRCSSVTSVSLSSPSDASAASSSTCASPPSLTSANKKNFAPGETPAAIANSSGQPYQPLREVLPGNRRGGQGYRPQGQKSNDPMNQGRHDSMGRYRNSSWYSSGSRYQSAPSQAPGNTIERGQTHSAGTNGTRVSMEPSPPTPSFKKGLPQRKPRTSQTEAVNS

SEQ ID NO: 1324 - protein, 462 aa, Homo sapiens
MDKDSQGLLDSSLMASGTASRSEDEESLAGQKRASSQALGTIPKRRSSSRFIKRKKFDDELVESSLAKSSTRAKGASGVEPGRCSGSEPSSSEKKKVSKAPSTPVPPSPAPAPGLTKRVKKSKQPLQVTKDLGRWKPADDLLLINAVLQTNDLTSVHLGVKFSCRFTLREVQERWYALLYDPVISKLACQAMRQLHPEAIAAIQSKALFSKAEEQLLSKVGSTSQPTLETFQDLLHRHPDAFYLARTAKALQAHWQLMKQYYLLEDQTVQPLPKGDQVLNFSDAEDLIDDSKLKDMRDEVLEHELMVADRRQKREIRQLEQELHKWQVLVDSITGMSSPDFDNQTLAVLRGRMVRYLMRSREITLGRATKDNQIDVDLSLEGPAWKISRKQGVIKLKNNGDFFIANEGRRPIYIDGRPVLCGSKWRLSNNSVVEIASLRFVFLINQDLIALIRAEAAKITPQ

SEQ ID NO: 1325 - protein, 237 aa, Homo sapiens
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGSIWPFQANLYVGLVVMCGFVLVDTQLIIEKAEHGDQDYIWHCIDLFLDFITVFRKLMMILAMNEKDKKKEKK

SEQ ID NO: 1326 - protein, 632 aa, Homo sapiens
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLNRGQPSSSNAGNKRLSTIDESGSILSDISFDKTDESLDWDSSLVKTFKLKKREKRRSTSRQFVDGPPGPVKKTRSIGSAVDQGNESIVAKTTVTVPNDGGPIEAVSTIETVPYWTRSRRKTGTLQPWNSDSTLNSRQLEPRTETDSVGTPQSNGGMRLHDFVSKTVIKPESCVPCGKRIKFGKLSLKCRDCRVVSHPECRDRCPLPCIPTLIGTPVKIGEGMLADFVSQTSPMIPSIVVHCVNEIEQRGLTETGLYRISGCDRTVKELKEKFLRVKTVPLLSKVDDIHAICSLLKDFLRNLKEPLLTFRLNRAFMEAAEITDEDNSIAAMYQAVGELPQANRDTLAFLMIHLQRVAQSPHTKMDVANLAKVFGPTIVAHAVPNPDPVTMLQDIKRQPKVVERLLSLPLEYWSQFMMVEQENIDPLHVIENSNAFSTPQTPDIKVSLLGPVTTPEHQLLKTPSSSSLSQRVRSTLTKNTPRFGSKSKSATNLGRQGNFFASPMLK

SEQ ID NO: 1327 - protein, 561 aa, Homo sapiens
MVLGPEQKMSDDSVSGDHGESASLGNINPAYSNPSLSQSPGDSEEYFATYFNEKISIPEEEYSCFSFRKLWAFTGPGFLMSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYEYVTVKPSQSQVLKGMFVPSCSGCRTPQIEQAVGIVGAVIMPHNMYLHSALVKSRQVNRNNKQEVREANKYFFIESCIALFVSFIINVFVVSVFAEAFFGKTNEQVVEVCTNTSSPHAGLFPKDNSTLAVDIYKGGVVLGCYFGPAALYIWAVGILAAGQSSTMTGTYSGQFVMEGFLNLKWSRFARVVLTRSIAIIPTLLVAVFQDVEHLTGMNDFLNVLQSLQLPFALIPILTFTSLRPVMSDFANGLGWRIAGGILVLIICSINMYFVVVYVRDLGHVALYVVAAVVSVAYLGFVFYLGWQCLIALGMSFLDCGHTVSISKGLLTEEATRGYVK

SEQ ID NO: 1328 - protein, 502 aa, Homo sapiens
MAWALKLPLADEVIESGLVQDFDASLSGIGQELGAGAYSMSDVLALPIFKQEESSLPPDNENKILPFQYVLCAATSPAVKLHDETLTYLNQGQSYEIRMLDNRKLGELPEINGKLVKSIFRVVFHDRRLQYTEHQQLEGWRWNRPGDRILDIDIPMSVGIIDPRANPTQLNTVEFLWDPAKRTSVFIQVHCISTEFTMRKHGGEKGVPFRVQIDTFKENENGEYTEHLHSASCQIKVFKPKGADRKQKTDREKMEKRTPHEKEKYQPSYETTILTECSPWPEITYVNNSPSPGFNSSHSSFSLGEGNGSPNHQPEPPPPVTDNLLPTTTPQEAQQWLHRNRFSTFTRLFTNFSGADLLKLTRDDVIQICGPADGIRLFNALKGRMVRPRLTIYVCQESLQLREQQQQQQQQQQKHEDGDSNGTFFVYHAIYLEELTAVELTEKIAQLFSISPCQISQIYKQGPTGIHVLISDEMIQNFQEEACFILDTMKAETNDSYHIILK

SEQ ID NO: 1329 - protein, 168 aa, Homo sapiens
MNSKGQYPTQPTYPVQPPGNPVYPQTLHLPQAPPYTDAPPAYSELYRPSFVHPGAATVPTMSAAFPGASLYLPMAQSVAVGPLGSTIPMAYYPVGPIYPPGSTVLVEGGYDAGARFGAGATAGNIPPPPPGCPPNAAQLAVMQGANVLVTQRKGNFFMGGSDGGYTIW

SEQ ID NO: 1330 - protein, 46 aa, Homo sapiens
MNLQKVSPVPSSRWRVTWPRAARKRNISSNDSQAPRSLFLAPSLTR

SEQ ID NO: 1331 - protein, 258 aa, Homo sapiens
MLVLYGHSTQDLPETNARVVGGTEAGRNSWPSQISLQYRSGGSRYHTCGGTLIRQNWVMTAAHCVDYQKTFRVVAGDHNLSQNDGTEQYVSVQKIVVHPYWNSDNVAAGYDIALLRLAQSVTLNSYVQLGVLPQEGAILANNSPCYITGWGKTKTNGQLAQTLQQAYLPSVDYAICSSSSYWGSTVKNTMVCAGGDGVRSGCQGDSGGPLHCLVNGKYSLHGVTSFVSSRGCNVSRKPTVFTQVSAYISWINNVIASN

SEQ ID NO: 1332 - protein, 505 aa, Homo sapiens
MAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKDNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGVHEEYQLPYYDLVPSDPSIEEMRKVVCDQKLRPNIPNWWQSYEALRVMGKMMRECWYANGAARLTALRIKKTLSQLSVQEDVKI

SEQ ID NO: 1333 - protein, 476 aa, Homo sapiens
MAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKDNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGVHEEYQLPYYDLVPSDPSIEEMRKVVCDQKLRPNIPNWWQSYEVRSWPPAAFPSA

SEQ ID NO: 1334 - protein, 487 aa, Homo sapiens
MAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKDNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGTFLFCLCSYLPFQDAGSPKAVLLPPFFLQPVGCLLPEPESSFKVAIKGVEVAVLRVRLFFRDQFVE

SEQ ID NO: 1335 - protein, 505 aa, Homo sapiens; identical to SEQ ID NO: 1332

SEQ ID NO: 1336 - protein, 476 aa, Homo sapiens; identical to SEQ ID NO: 1333

SEQ ID NO: 1337 - protein, 487 aa, Homo sapiens; identical to SEQ ID NO: 1334

SEQ ID NO: 1338 - protein, 611 aa, Homo sapiens
MAASAKKKNKKGKTISLTDFLAEDGGTGGGSTYVSKPVSWADETDDLEGDVSTTWHSNDDDVYRAPPIDRSILPTAPRAAREPNIDRSRLPKSPPYTAFLGNLPYDVTEESIKEFFRGLNISAVRLPREPSNPERLKGFGYAEFEDLDSLLSALSLNEESLGNRRIRVDVADQAQDKDRDDRSFGRDRNRDSDKTDTDWRARPATDSFDDYPPRRGDDSFGDKYRDRYDSDRYRDGYRDGYRDGPRRDMDRYGGRDRYDDRGSRDYDRGYDSRIGSGRRAFGSGYRRDDDYRGGGDRYEDRYDRRDDRSWSSRDDYSRDDYRRDDRGPPQRPKLNLKPRSTPEEDDSSASTSQSTRAASIFGGAKPVDTAAREREVEERLQKEQEKLQRQWNEPKLERRPRERHPSWRSEETQERERSRTGSESSQTGTSTTSSRNARRRESEKSLENETLNKEEDCHSPTSKPPKPDQPLKVMPAPPPKENAWVKRSSNPPARSQSSDTEQQSPTSGGGKVAPAQPSEEGPGRKDENKVDGMNAPKGQTGNSSRGPGDGGNRDHWKESDRKDGKKDQDSRSAPEPKKPEENPASKFSSASKYAALSVDGEDENEGEDYAE

SEQ ID NO: 1339 - protein, 454 aa, Homo sapiens
MATNKERLFAAGALGPGSGYPGAGFPFAFPGALRGSPPFEMLSPSFRGLGQPDLPKEMASLSVETQSTSSEEMVPSSPSPPPPPRVYKPCFVCNDKSSGYHYGVSSCEGCKGFFRRSIQKNMVYTCHRDKNCIINKVTRNRCQYCRLQKCFEVGMSKEAVRNDRNKKKKEVKEEGSPDSYELSPQLEELITKVSKAHQETFPSLCQLGKYTTNSSADHRVQLDLGLWDKFSELATKCIIKIVEFAKRLPGFTGLSIADQITLLKAACLDILMLRICTRYTPEQDTMTFSDGLTLNRTQMHNAGFGPLTDLVFAFAGQLLPLEMDDTETGLLSAICLICGDRMDLEEPEKVDKLQEPLLEALRLYARRRRPSQPYMFPRMLMKITDLRGISTKGAERAITLKMEIPGPMPPLIREMLENPEMFEDDSSQPGPHPNASSEDEVPGGQGKGGLKSPA

SEQ ID NO: 1340 - protein, 450 aa, Homo sapiens
MLVTAYLAFVGLLASCLGLELSRCRAKPPGRACSNPSFLRFQLDFYQVYFLALAADWLQAPYLYKLYQHYYFLEGQIAILYVCGLASTVLFGLVASSLVDWLGRKNSCVLFSLTYSLCCLTKLSQDYFVLLVGRALGGLSTALLFSAFEAWYIHEHAERHDFPAEWIPATFARAAFWNHVLAVVAGVAAEAVASWIGLGPVAPFVAAIPLLALAGALALRNWGENYDRQRAFSRTCAGGLRCLLSDRRVLLLGTIQALFESVIFIFVFLWTPVLDPHGAPLGIIFSSFMAASLLGSSLYRIATSKRYHLQPMHLLSLAVLIVVFSLFMLTFSTSPGQESPVESFIAFLLIELACGLYFPSMSFLRRKVIPETEQAGVLNWFRVPLHSLACLGLLVLHDSDRKTGTRNMFSICSAVMVMALLAVVGLFTVVRHDAELRVPSPTEEPYAPEL

SEQ ID NO: 1341 - protein, 154 aa, Homo sapiens
MAQSINITELNLPQLEMLKNQLDQEVEFLSTSIAQLKVVQTKYVEAKDCLNVLNKSNEGKELLVPLTSSMYVPGKLHDVEHVLIDVGTGYYVEKTAEDAKDFFKRKIDFLTKQMEKIQPALQEKHAMKQAVMEMMSQKIQQLTALGAAQATAKA

SEQ ID NO: 1342 - protein, 66 aa, Homo sapiens
MAQSINITELNLPQLEMLKNQLDQEVEFLSTSIAQLKVVQTKYVEAKDCLNVLNKSNEDVCPWEAA

SEQ ID NO: 1343 - protein, 109 aa, Homo sapiens
MAQSINITELNLPQLEMLKNQLDQMYVPGKLHDVEHVLIDVGTGYYVEKTAEDAKDFFKRKIDFLTKQMEKIQPALQEKHAMKQAVMEMMSQKIQQLTALGAAQATAKA

SEQ ID NO: 1344 - protein, 376 aa, Homo sapiens
MGHRFLRGLLTLLLPPPPLYTRHRMLGPESVPPPKRSRSKLMAPPRIGTHNGTFHCDEALACALLRLLPEYRDAEIVRTRDPEKLASCDIVVDVGGEYDPRRHRYDHHQRSFTETMSSLSPGKPWQTKLSSAGLIYLHFGHKLLAQLLGPSEEDSMVGTLYDKMYENFVEEVDAVDNGISQWAEGEPRYALTTTLSARVARLNPTWNHPDQDTEAGFKRAMDLVQEEFLQRLDFYQHSWLPARALVEEALAQRFQVDPSGEIVELAKGACPWKEHLYHLESGLSPPVAIFFVIYTDQAGQWRIQCVPKEPHSFQSRLPLPEPWRGLRDEALDQVSGIPGCIFVHASGFIGGHPTREGALSMARATLAQRSYLPQIS

SEQ ID NO: 1345 - protein, 304 aa, Homo sapiens
MFNSVNLGNFCSPSRKERGADFGERGSCASNLYLPSCTYYMPEFSTVSSFLPQAPSRQISYPYSAQVPPVREVSYGLEPSGKWHHRNSYSSCYAAADELMHRECLPPSTVTEILMKNEGSYGGHHHPSAPHATPAGFYSSVNKNSVLPQAFDRFFDNAYCGGGDPPAEPPCSGKGEAKGEPEAPPASGLASRAEAGAEAEAEEENTNPSSSGSAHSVAKEPAKGAAPNAPRTRKKRCPYSKFQIRELEREFFFNVYINKEKRLQLSRMLNLTDRQVKIWFQNRRMKEKKLSRDRLQYFSGNPLL

SEQ ID NO: 1346 - protein, 235 aa, Homo sapiens
MNSYFTNPSLSCHLAGGQDVLPNVALNSTAYDPVRHFSTYGAAVAQNRIYSTPFYSPQENVVFSSSRGPYDYGSNSFYQEKDMLSNCRQNTLGHNTQTSIAQDFSSEQGRTAPQDQKASIQIYPWMQRMNSHSGVGYGADRRRGRQIYSRYQTLELEKEFHFNRYLTRRRRIEIANALCLTERQIKIWFQNRRMKWKKESNLTSTLSGGGGGATADSLGGKEEKREETEEEKQKE

SEQ ID NO: 1347 - protein, 153 aa, Homo sapiens
MLSNCRQNTLGHNTQTSIAQDFSSEQGRTAPQDQKASIQIYPWMQRMNSHSGVGYGADRRRGRQIYSRYQTLELEKEFHFNRYLTRRRRIEIANALCLTERQIKIWFQNRRMKWKKESNLTSTLSGGGGGATADSLGGKEEKREETEEEKQKE

SEQ ID NO: 1348 - protein, 270 aa, Homo sapiens
MPQAFLLGSIHEPAGALMEPQPCPGSLAESFLEEELRLNAELSQLQFSEPVGIIYNPVEYAWEPHRNYVTRYCQGPKEVLFLGMNPGPFGMAQTGVPFGEVSMVRDWLGIVGPVLTPPQEHPKRPVLGLECPQSEVSGARFWGFFRNLCGQPEVFFHHCFVHNLCPLLFLAPSGRNLTPAELPAKQREQLLGICDAALCRQVQLLGVRLVVGVGRLAEQRARRALAGLMPEVQVEGLLHPSPRNPQANKGWEAVAKERLNELGLLPLLLK

SEQ ID NO: 1349 - protein, 320 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGSNFGGGGSYNDFGNYNNQSSNFGPMKGGNFGGRSSGPYGGGGQYFAKPRNQGGYGGSSSSSSYGSGRRF

SEQ ID NO: 1350 - protein, 372 aa, Homo sapiens
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGGYGGGGPGYSGGSRGYGSGGQGYGNQGSGYGGSGSYDSYNNGGGGGFGGGSGSNFGGGGSYNDFGNYNNQSSNFGPMKGGNFGGRSSGPYGGGGQYFAKPRNQGGYGGSSSSSSYGSGRRF

SEQ ID NO: 1351 - protein, 177 aa, Homo sapiens
MEALILEPSLYTVKAILILDNDGDRLFAKYYDDTYPSVKEQKAFEKNIFNKTHRTDSEIALLEGLTVVYKSSIDLYFYVIGSSYENELMLMAVLNCLFDSLSQMLRKNVEKRALLENMEGLFLAVDEIVDGGVILESDPQQVVHRVALRGEDVPLTEQTVSQVLQSAKEQIKWSLLR

SEQ ID NO: 1352 - protein, 125 aa, Homo sapiens
MLSRLLKEHQAKQNERKELQEKRRREAITAATCLTEALVDHLNVGVAQAYMNQRKLDHEVKTLQVQAAQFAKQTGQWIGMVENFNQALKEIGDVENWARSIELDMRTIATALEYVYKGQLQSAPS

SEQ ID NO: 1353 - protein, 238 aa, Homo sapiens
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDWEKIPSMSKNRVPDSCCINVTVGCGINFNEKAIHKEGCVEKIGGWLRKNVLVVAAAALGIAFVEVLGIVFACCLVKSIRSGYEVM

SEQ ID NO: 1354 - protein, 153 aa, Homo sapiens
MNVGVAHSEVNPNTRVMNSRGIWLAYIILVGLLHMVLLSIPFFSIPVVWTLTNVIHNLATYVFLHTVKGTPFETPDQGKARLLTHWEQMDYGLQFTSSRKFLSISPIVLYLLASFYTKYDAAHFLINTASLLSVLLPKLPQFHGVRVFGINKY

SEQ ID NO: 1355 - protein, 151 aa, Homo sapiens
MCDFTEDQTAEFKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEAFVRHILSG

SEQ ID NO: 1356 - protein, 116 aa, Homo sapiens
MRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEELVRMVLNG

SEQ ID NO: 1357 - protein, 116 aa, Homo sapiens
MRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEAFVRHILSG

SEQ ID NO: 1358 - protein, 157 aa, Homo sapiens
MCDFTEDQTADLIPSTEFKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEAFVRHILSG

SEQ ID NO: 1359 - protein, 962 aa, Homo sapiens
MDEQALLGLNPNADSDFRQRALAYFEQLKISPDAWQVCAEALAQRTYSDDHVKFFCFQVLEHQVKYKYSELTTVQQQLIRETLISWLQAQMLNPQPEKTFIRNKAAQVFALLFVTEYLTKWPKFFFDILSVVDLNPRGVDLYLRILMAIDSELVDRDVVHTSEEARRNTLIKDTMREQCIPNLVESWYQILQNYQFTNSEVTCQCLEVVGAYVSWIDLSLIANDRFINMLLGHMSIEVLREEACDCLFEVVNKGMDPVDKMKLVESLCQVLQSAGFFSIDQEEDVDFLARFSKLVNGMGQSLIVSWSKLIKNGDIKNAQEALQAIETKVALMLQLLIHEDDDISSNIIGFCYDYLHILKQLTVLSDQQKANVEAIMLAVMKKLTYDEEYNFENEGEDEAMFVEYRKQLKLLLDRLAQVSPELLLASVRRVFSSTLQNWQTTRFMEVEVAIRLLYMLAEALPVSHGAHFSGDVSKASALQDMMRTLVTSGVSSYQHTSVTLEFFETVVRYEKFFTVEPQHIPCVLMAFLDHRGLRHSSAKVRSRTAYLFSRFVKSLNKQMNPFIEDILNRIQDLLELSPPENGHQSLLSSDDQLFIYETAGVLIVNSEYPAERKQALMRNLLTPLMEKFKILLEKLMLAQDEERQASLADCLNHAVGFASRTSKAFSNKQTVKQCGCSEVYLDCLQTFLPALSCPLQKDILRSGVRTFLHRMIICLEEEVLPFIPSASEHMLKDCEAKDLQEFIPLINQITAKFKIQVSPFLQQMFMPLLHAIFEVLLRPAEENDQSAALEKQMLRRSYFAFLQTVTGSGMSEVIANQGAENVERVLVTVIQGAVEYPDPIAQKTCFIILSKLVELWGGKDGPVGFADFVYKHIVPACFLAPLKQTFDLADAQTVLALSECAVTLKTIHLKRGPECVQYLQQEYLPSLQVAPEIIQEFCQALQQPDAKVFKNYLKVFFQRAKP

SEQ ID NO: 1360 - protein, 729 aa, Homo sapiens
MQSTSNHLWLLSDILGQGATANVFRGRHKKTGDLFAIKVFNNISFLRPVDVQMREFEVLKKLNHKNIVKLFAIEEETTTRHKVLIMEFCPCGSLYTVLEEPSNAYGLPESEFLIVLRDVVGGMNHLRENGIVHRDIKPGNIMRVIGEDGQSVYKLTDFGAARELEDDEQFVSLYGTEEYLHPDMYERAVLRKDHQKKYGATVDLWSIGVTFYHAATGSLPFRPFEGPRRNKEVMYKIITGKPSGAISGVQKAENGPIDWSGDMPVSCSLSRGLQVLLTPVLANILEADQEKCWGFDQFFAETSDILHRMVIHVFSLQQMTAHKIYIHSYNTATIFHELVYKQTKIISSNQELIYEGRRLVLEPGRLAQHFPKTTEENPIFVVSREPLNTIGLIYEKISLPKVHPRYDLDGDASMAKAITGVVCYACRIASTLLLYQELMRKGIRWLIELIKDDYNETVHKKTEVVITLDFCIRNIEKTVKVYEKLMKINLEAAELGEISDIHTKLLRLSSSQGTIETSLQDIDSRLSPGGSLADAWAHQEGTHPKDRNVEKLQVLLNCMTEIYYQFKKDKAERRLAYNEEQIHKFDKQKLYYHATKAMTHFTDECVKKYEAFLNKSEEWIRKMLHLRKQLLSLTNQCFDIEEEVSKYQEYTNELQETLPQKMFTASSGIKHTMTPIYPSSNTLVEMTLGMKKLKEEMEGVVKELAENNHILERFGSLTMDGGLRNVDCL

SEQ ID NO: 1361 - protein, 552 aa, Homo sapiens
MRLLPLAPGRLRRGSPRHLPSCSPALLLLVLGGCLGVFGVAAGTRRPNVVLLLTDDQDEVLGGMTPLKKTKALIGEMGMTFSSAYVPSALCCPSRASILTGKYPHNHHVVNNTLEGNCSSKSWQKIQEPNTFPAILRSMCGYQTFFAGKYLNEYGAPDAGGLEHVPLGWSYWYALEKNSKYYNYTLSINGKARKHGENYSVDYLTDVLANVSLDFLDYKSNFEPFFMMIATPAPHSPWTAAPQYQKAFQNVFAPRNKNFNIHGTNKHWLIRQAKTPMTNSSIQFLDNAFRKRWQTLLSVDDLVEKLVKRLEFTGELNNTYIFYTSDNGYHTGQFSLPIDKRQLYEFDIKVPLLVRGPGIKPNQTSKMLVANIDLGPTILDIAGYDLNKTQMDGMSLLPILRGASNLTWRSDVLVEYQGEGRNVTDPTCPSLSPGVSQCFPDCVCEDAYNNTYACVRTMSALWNLQYCEFDDQEVFVEVYNLTADPDQITNIAKTIDPELLGKMNYRLMMLQSCSGPTCRTPGVFDPGYRFDPRLMFSNRGSVRTRRFSKHLL

SEQ ID NO: 1362 - protein, 552 aa, Homo sapiens; identical to SEQ ID NO: 1361

SEQ ID NO: 1363 - protein, 911 aa, Homo sapiens
MAAAAASAPQQLSDEELFSQLRRYGLSPGPVTESTRPVYLKKLKKLREEEQQQHRSGGRGNKTRNSNNNNTAAATVAAAGPAAAAAAGMGVRPVSGDLSYLRTPGGLCRISASGPESLLGGPGGASAAPAAGSKVLLGFSSDESDVEASPRDQAGGGGRKDRASLQYRGLKAPPAPLAASEVTNSNSAERRKPHSWWGARRPAGPELQTPPGKDGAVEDEEGEGEDGEERDPETEEPLWASRTVNGSRLVPYSCRENYSDSEEEDDDDVASSRQVLKDDSLSRHRPRRTHSKPLPPLTAKSAGGRLETSVQGGGGLAMNDRAAAAGSLDRSRNLEEAAAAEQGGGCDQVDSSPVPRYRVNAKKLTPLLPPPLTDMDSTLDSSTGSLLKTNNHIGGGAFSVDSPRIYSNSLPPSAAVAASSSLRINHANHTGSNHTYLKNTYNKPKLSEPEEELLQQFKREEVSPTGSFSAHYLSMFLLTAACLFFLILGLTYLGMRGTGVSEDGELSIENPFGETFGKIQESEKTLMMNTLYKLHDRLAQLAGDHECGSSSQRTLSVQEAAAYLKDLGPEYEGIFNTSLQWILENGKDVGIRCVGFGPEEELTNITDVQFLQSTRPLMSFWCRFRRAFVTVTHRLLLLCLGVVMVCVVLRYMKYRWTKEEEETRQMYDMVVKIIDVLRSHNEACQENKDLQPYMPIPHVRDSLIQPHDRKKMKKVWDRAVDFLAANESRVRTETRRIGGADFLVWRWIQPSASCDKILVIPSKVWQGQAFHLDRRNSPPNSLTPCLKIRNMFDPVMEIGDQWHLAIQEAILEKCSDNDGIVHIAVDKNSREGCVYVKCLSPEYAGKAFKALHGSWFDGKLVTVKYLRLDRYHHRFPQALTSNTPLKPSNKHMNSMSHLRLRTGLTNSQGSS

SEQ ID NO: 1364 - protein, 258 aa, Homo sapiens
MWSSVGSHVGPGPVGVAVAIMADPDPRYPRSSIEDDFNYGSSVASATVHIRMAFLRKVYSILSLQVLLTTVTSTVFLYFESVRTFVHESPALILLFALGSLGLIFALTLNRHKYPLNLYLLFGFTLLEALTVAVVVTFYDVYIILQAFILTTTVFFGLTVYTLQSKKDFSKFGAGLFALLWILCLSGFLKFFFYSEIMELVLAAAGALLFCGFIIYDTHSLMHKLSPEEYVLAAISLYLDIINLFLHLLRFLEAVNKK

SEQ ID NO: 1365 - protein, 1230 aa, Homo sapiens
MASASYHISNLLEKMTSSDKDFRFMATNDLMTELQKDSIKLDDDSERKVVKMILKLLEDKNGEVQNLAVKCLGPLVSKVKEYQVETIVDTLCTNMLSDKEQLRDISSIGLKTVIGELPPASSGSALAANVCKKITGRLTSAIAKQEDVSVQLEALDIMADMLSRQGGLLVNFHPSILTCLLPQLTSPRLAVRKRTIIALGHLVMSCGNIVFVDLIEHLLSELSKNDSMSTTRTYIQCIAAISRQAGHRIGEYLEKIIPLVVKFCNVDDDELREYCIQAFESFVRRCPKEVYPHVSTIINICLKYLTYDPNYNYDDEDEDENAMDADGGDDDDQGSDDEYSDDDDMSWKVRRAAAKCLDAVVSTRHEMLPEFYKTVSPALISRFKEREENVKADVFHAYLSLLKQTRPVQSWLCDPDAMEQGETPLTMLQSQVPNIVKALHKQMKEKSVKTRQCCFNMLTELVNVLPGALTQHIPVLVPGIIFSLNDKSSSSNLKIDALSCLYVILCNHSPQVFHPHVQALVPPVVACVGDPFYKITSEALLVTQQLVKVIRPLDQPSSFDATPYIKDLFTCTIKRLKAADIDQEVKERAISCMGQIICNLGDNLGSDLPNTLQIFLERLKNEITRLTTVKALTLIAGSPLKIDLRPVLGEGVPILASFLRKNQRALKLGTLSALDILIKNYSDSLTAAMIDAVLDELPPLISESDMHVSQMAISFLTTLAKVYPSSLSKISGSILNELIGLVRSPLLQGGALSAMLDFFQALVVTGTNNLGYMDLLRMLTGPVYSQSTALTHKQSYYSIAKCVAALTRACPKEGPAVVGQFIQDVKNSRSTDSIRLLALLSLGEVGHHIDLSGQLELKSVILEAFSSPSEEVKSAASYALGSISVGNLPEYLPFVLQEITSQPKRQYLLLHSLKEIISSASVVGLKPYVENIWALLLKHCECAEEGTRNVVAECLGKLTLIDPETLLPRLKGYLISGSSYARSSVVTAVKFTISDHPQPIDPLLKNCIGDFLKTLEDPDLNVRRVALVTFNSAAHNKPSLIRDLLDTVLPHLYNETKVRKELIREVEMGPFKHTVDDGLDIRKAAFECMYTLLDSCLDRLDIFEFLNHVEDGLKDHYDIKMLTFLMLVRLSTLCPSAVLQRLDRLVEPLRATCTTKVKANSVKQEFEKQDELKRSAMRAVAALLTIPEAEKSPLMSEFQSQISSNPELAAIFESIQKDSSSTNLESMDTS

SEQ ID NO: 1366 - protein, 1230 aa, Homo sapiens; identical to SEQ ID NO: 1365

SEQ ID NO: 1367 - protein, 528 aa, Homo sapiens
MNDHLHVGSHAHGQIQVQQLFEDNSNKRTVLTTQPNGLTTVGKTGLPVVPERQLDSIHRRQGSSTSLKSMEGMGKVKATPMTPEQAMKQYMQKLTAFEHHEIFSYPEIYFLGLNAKKRQGMTGGPNNGGYDDDQGSYVQVPHDHVAYRYEVLKVIGKGSFGQVVKAYDHKVHQHVALKMVRNEKRFHRQAAEEIRILEHLRKQDKDNTMNVIHMLENFTFRNHICMTFELLSMNLYELIKKNKFQGFSLPLVRKFAHSILQCLDALHKNRIIHCDLKPENILLKQQGRSGIKVIDFGSSCYEHQRVYTYIQSRFYRAPEVILGARYGMPIDMWSLGCILAELLTGYPLLPGEDEGDQLACMIELLGMPSQKLLDASKRAKNFVSSKGYPRYCTVTTLSDGSVVLNGGRSRRGKLRGPPESREWGNALKGCDDPLFLDFLKQCLEWDPAVRMTPGQALRHPWLRRRLPKPPTGEKTSVKRITESTGAITSISKLPPPSSSASKLRTNLAQMTDANGNIQQRTVLPKLVS

SEQ ID NO: 1368 - protein, 601 aa, Homo sapiens
MLTRKPSAAAPAAYPTGRGGDSAVRQLQASPGLGAGPTRSGVGTGPPSPIALPPLRASNAAAAAHTIGGSKHTMNDHLHVGSHAHGQIQVQQLFEDNSNKRTVLTTQPNGLTTVGKTGLPVVPERQLDSIHRRQGSSTSLKSMEGMGKVKATPMTPEQAMKQYMQKLTAFEHHEIFSYPEIYFLGLNAKKRQGMTGGPNNGGYDDDQGSYVQVPHDHVAYRYEVLKVIGKGSFGQVVKAYDHKVHQHVALKMVRNEKRFHRQAAEEIRILEHLRKQDKDNTMNVIHMLENFTFRNHICMTFELLSMNLYELIKKNKFQGFSLPLVRKFAHSILQCLDALHKNRIIHCDLKPENILLKQQGRSGIKVIDFGSSCYEHQRVYTYIQSRFYRAPEVILGARYGMPIDMWSLGCILAELLTGYPLLPGEDEGDQLACMIELLGMPSQKLLDASKRAKNFVSSKGYPRYCTVTTLSDGSVVLNGGRSRRGKLRGPPESREWGNALKGCDDPLFLDFLKQCLEWDPAVRMTPGQALRHPWLRRRLPKPPTGEKTSVKRITESTGAITSISKLPPPSSSASKLRTNLAQMTDANGNIQQRTVLPKLVS

SEQ ID NO: 1369 - protein, 184 aa, Homo sapiens
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLREQILRVKDTDDVPMILVGNKCDLEDERVVGKEQGQNLARQWNNCAFLESSAKSKINVNEIFYDLVRQINRKTPVPGKARKKSSCQLL

SEQ ID NO: 1370 - protein, 354 aa, Homo sapiens
MPLLGQTVRSASARTRRWSRRAAGDRPGASSEARRPQLRGDHGIVVDRVRGHWRIAAGSCSTCWCPSALCSSTNGFMCTTGFPNMSLTLVHFVVTWLGLYICQKLDIFAPKSLPPSRLLLLALSFCGFVVFTNLSLQNNTIGTYQLAKAMTTPVIIAIQTFCYQKTFSTRIQLTLIPITLGVILNSYYDVKFNFLGMVFAALGVLVTSLYQVWVGAKQHELQVNSMQLLYYQAPMSSAMLLVAVPFFEPVFGEGGIFGPWSVSALLMVLLSGVIAFMVNLSIYWIIGNTSPVTYNMFGHFKFCIALFGGYVLFKDPLSINQALDILCTLFGILAYTHFKLSEQEGSRSKLAQRP

SEQ ID NO: 1371 - protein, 227 aa, Homo sapiens
MFKRMAEFGPDSGGRVKGVTIVKPIVYGNVARYFGKKREEDGHTHQWTVYVKPYRNEDMSAYVKKIQFKLHESYGNPLRVVTKPPYEITETGWGEFEIIIKIFFIDPNERPVTLYHLLKLFQSDTNAMLGKKTVVSEFYDEMIFQDPTAMMQQLLTTSRQLTLGAYKHETEFAELEVKTREKLEAAKKKTSFEIAELKERLKASRETINCLKNEIRKLEEDDQAKDI

SEQ ID NO: 1372 - protein, 535 aa, Homo sapiens
MASLSLAPVNIFKAGADEERAETARLTSFIGAIAIGDLVKSTLGPKGMDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGFLLDKKIGVNQPKRIENAKILIANTGMDTDKIKIFGSRVRVDSTAKVAEIEHAEKEKMKEKVERILKHGINCFINRQLIYNYPEQLFGAAGVMAIEHADFAGVERLALVTGGEIASTFDHPELVKLGSCKLIEEVMIGEDKLIHFSGVALGEACTIVLRGATQQILDEAERSLHDALCVLAQTVKDSRTVYGGGCSEMLMAHAVTQLANRTPGKEAVAMESYAKALRMLPTIIADNAGYDSADLVAQLRAAHSEGNTTAGLDMREGTIGDMAILGITESFQVKRQVLLSAAEAAEVILRVDNIIKAAPRKRVPDHHPC

SEQ ID NO: 1373 - protein, 1030 aa, Homo sapiens
MKMADAKQKRNEQLKRWIGSETDLEPPVVKRQKTKVKFDDGAVFLAACSSGDTDEVLKLLHRGADINYANVDGLTALHQACIDDNVDMVKFLVENGANINQPDNEGWIPLHAAASCGYLDIAEFLIGQGAHVGAVNSEGDTPLDIAEEEAMEELLQNEVNRQGVDIEAARKEEERIMLRDARQWLNSGHINDVRHAKSGGTALHVAAAKGYTEVLKLLIQAGYDVNIKDYDGWTPLHAAAHWGKEEACRILVDNLCDMEMVNKVGQTAFDVADEDILGYLEELQKKQNLLHSEKRDKKSPLIESTANMDNNQSQKTFKNKETLIIEPEKNASRIESLEQEKVDEEEEGKKDESSCSSEEDEEDDSESEAETDKTKPLASVTNANTSSTQAAPVAVTTPTVSSGQATPTSPIKKFPTTATKISPKEEERKDESPATWRLGLRKTGSYGALAEITASKEGQKEKDTAGVTRSASSPRLSSSLDNKEKEKDSKGTRLAYVAPTIPRRLASTSDIEEKENRDSSSLRTSSSYTRRKWEDDLKKNSSVNEGSTYHKSCSFGRRQDDLISSSVPSTTSTPTVTSAAGLQKSLLSSTSTTTKITTGSSSAGTQSSTSNRLWAEDSTEKEKDSVPTAVTIPVAPTVVNAAASTTTLTTTTAGTVSSTTEVRERRRSYLTPVRDEESESQRKARSRQARQSRRSTQGVTLTDLQEAEKTIGRSRSTRTREQENEEKEKEEKEKQDKEKQEEKKESETSREDEYKQKYSRTYDETYQRYRPVSTSSSTTPSSSLSTMSSSLYASSQLNRPNSLVGITSAYSRGITKENEREGEKREEEKEGEDKSQPKSIRERRRPREKRRSTGVSFWTQDSDENEQEQQSDTEEGSNKKETQTDSISRYETSSTSAGDRYDSLLGRSGSYSYLEERKPYSSRLEKDDSTDFKKLYEQILAENEKLKAQLHDTNMELTDLKLQLEKATQRQERFADRSLLEMEKRERRALERRISEMEEELKMLPDLKADNQRLKDENGALIRVISKLSK

SEQ ID NO: 1374 - protein, 241 aa, Homo sapiens
MAPVRRSAKWRPGGIEARGEGVSTVGYRNKNVRQKTWRPNHPQAFVGSVREGQGFAFRRKLKIQQSYKKLLRKEKKAQTSLESQFTDRYPDNLKHLYLAEEERHRKQARKVDHPLSEQVHQPLLEEQCSIDEPLFEDQCSFDQPQPEEQCIKTVNSFTISKKNKKKTSNQKAQEEYEQIQAKRAAKKQEFERRKQEREEAQRQYKKKKMEVFKILNKKTKKGQPNLNVQMEYLLQKIQEKC

SEQ ID NO: 1375 - protein, 574 aa, Homo sapiens
MPPNINWKEIMKVDPDDLPRQEELADNLLISLSKVEVNELKSEKQENVIHLFRITQSLMKMKAQEVELALEEVEKAGEEQAKFENQLKTKVMKLENELEMAQQSAGGRDTRFLRNEICQLEKQLEQKDRELEDMEKELEKEKKVNEQLALRNEEAENENSKLRRENKRLKKKNEQLCQDIIDYQKQIDSQKETLLSRRGEDSDYRSQLSKKNYELIQYLDEIQTLTEANEKIEVQNQEMRKNLEESVQEMEKMTDEYNRMKAIVHQTDNVIDQLKKENDHYQLQVQELTDLLKSKNEEDDPIMVAVNAKVEEWKLILSSKDDEIIEYQQMLHNLREKLKNAQLDADKSNVMALQQGIQERDSQIKMLTEQVEQYTKEMEKNTCIIEDLKNELQRNKGASTLSQQTHMKIQSTLDILKEKTKEAERTAELAEADAREKDKELVEALKRLKDYESGVYGLEDAVVEIKNCKNQIKIRDREIEILTKEINKLELKISDFLDENEALRERVGLEPKTMIDLTEFRNSKHLKQQQYRAENQILLKEIECLEEERLDLKKKNSSNGSRKRKKKCNFRINH

SEQ ID NO: 1376 - protein, 273 aa, Homo sapiens
MKKTQTWILTCIYLQLLLFNPLVKTEGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 1377 - protein, 245 aa, Homo sapiens
MKKTQTWILTCIYLQLLLFNPLVKTEGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKGKAKNPPGDSSLHWAAMALPALFSLIIGFAFGALYWKKRQPSLTRAVENIQINEEDNEISMLQEKEREFQEV

SEQ ID NO: 1378 - protein, 381 aa, Homo sapiens
MIDTLRPVPFASEMAISKTVAWLNEQLELGNERLLLMDCRPQELYESSHIESAINVAIPGIMLRRLQKGNLPVRALFTRGEDRDRFTRRCGTDTVVLYDESSSDWNENTGGESVLGLLLKKLKDEGCRAFYLEGGFSKFQAEFSLHCETNLDGSCSSSSPPLPVLGLGGLRISSDSSSDIESDLDRDPNSATDSDGSPLSNSQPSFPVEILPFLYLGCAKDSTNLDVLEEFGIKYILNVTPNLPNLFENAGEFKYKQIPISDHWSQNLSQFFPEAISFIDEARGKNCGVLVHCLAGISRSVTVTVAYLMQKLNLSMNDAYDIVKMKKSNISPNFNFMGQLLDFERTLGLSSPCDNRVPAQQLYFTTPSNQNVYQVDSLQST

SEQ ID NO: 1379 - protein, 235 aa, Homo sapiens
MIDTLRPVPFASEMAISKTVAWLNEQLELGNERLLLMDCRPQELYESSHIESAINVAIPGIMLRRLQKGNLPVRALFTRGEDRDRFTRRCGTDTVVLYDESSSDWNENTGGESVLGLLLKKLKDEGCRAFYLEDEARGKNCGVLVHCLAGISRSVTVTVAYLMQKLNLSMNDAYDIVKMKKSNISPNFNFMGQLLDFERTLGLSSPCDNRVPAQQLYFTTPSNQNVYQVDSLQST

SEQ ID NO: 1380 - protein, 1220 aa, Homo sapiens
MGDMANNSVAYSGVKNSLKEANHDGDFGITLAELRALMELRSTDALRKIQESYGDVYGICTKLKTSPNEGLSGNPADLERREAVFGKNFIPPKKPKTFLQLVWEALQDVTLIILEIAAIVSLGLSFYQPPEGDNALCGEVSVGEEEGEGETGWIEGAAILLSVVCVVLVTAFNDWSKEKQFRGLQSRIEQEQKFTVIRGGQVIQIPVADITVGDIAQVKYGDLLPADGILIQGNDLKIDESSLTGESDHVKKSLDKDPLLLSGTHVREGSGRMVVTAVGVNSQTGIIFTLLGAGGEEEEKKDEKKKEKKNKKQDGAIENRNKAKAQDGAAMEMQPLKSEEGGDGDEKDKKKANLPKKEKSVLQGKLTKLAVQIGKAGLLMSAITVIILVLYFVIDTFWVQKRPWLAECTPIYIQYFVKFFIIGVTVLVVAVPEGLPLAVTISLAYSVKKMMKDNNLVRHLDACETMGNATAICSDKTGTLTMNRMTVVQAYINEKHYKKVPEPEAIPPNILSYLVTGISVNCAYTSKILPPEKEGGLPRHVGNKTECALLGLLLDLKRDYQDVRNEIPEEALYKVYTFNSVRKSMSTVLKNSDGSYRIFSKGASEIILKKCFKILSANGEAKVFRPRDRDDIVKTVIEPMASEGLRTICLAFRDFPAGEPEPEWDNENDIVTGLTCIAVVGIEDPVRPEVPDAIKKCQRAGITVRMVTGDNINTARAIATKCGILHPGEDFLCLEGKDFNRRIRNEKGEIEQERIDKIWPKLRVLARSSPTDKHTLVKGIIDSTVSDQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTLASLALATEPPTESLLLRKPYGRNKPLISRTMMKNILGHAFYQLVVVFTLLFAGEKFFDIDSGRNAPLHAPPSEHYTIVFNTFVLMQLFNEINARKIHGERNVFEGIFNNAIFCTIVLGTFVVQIIIVQFGGKPFSCSELSIEQWLWSIFLGMGTLLWGQLISTIPTSRLKFLKEAGHGTQKEEIPEEELAEDVEEIDHAERELRRGQILWFRGLNRIQTQIRVVNAFRSSLYEGLEKPESRSSIHNFMTHPEFRIEDSEPHIPLIDDTDAEDDAPTKRNSSPPPSPNKNNNAVDSGIHLTIEMNKSATSSSPGSPLHSLETSL

SEQ ID NO: 1381 - protein, 1220 aa, Homo sapiens; identical to SEQ ID NO: 1380

SEQ ID NO: 1382 - protein, 171 aa, Homo sapiens
MHPFYTRAATMIGEIAAAVSFISKFLRTKGLTSERQLQTFSQSLQELLAEHYKHHWFPEKPCKGSGYRCIRINHKMDPLIGQAAQRIGLSSQELFRLLPSELTLWVDPYEVSYRIGEDGSICVLYEASPAGGSTQNSTNVQMVDSRISCKEELLLGRTSPSKNYNMMTVSG

SEQ ID NO: 1383 - protein, 155 aa, Homo sapiens
MSESKSGPEYASFFAVMGASAAMVFSALGAAYGTAKSGTGIAAMSVMRPEQIMKSIIPVVMAGIIAIYGLVVAVLIANSLNDDISLYKSFLQLGAGLSVGLSGLAAGFAIGIVGDAGVRGTAQQPRLFVGMILILIFAEVLGLYGLIVALILSTK

SEQ ID NO: 1384 - protein, 155 aa, Homo sapiens; identical to SEQ ID NO: 1383

SEQ ID NO: 1385 - protein, 439 aa, Homo sapiens
MRGEQGAAGARVLQFTNCRILRGGKLLREDLWVRGGRILDPEKLFFEERRVADERRDCGGRILAPGFIDVQINGGFGVDFSQATEDVGSGVALVARRILSHGVTSFCPTLVTSPPEVYHKVVPQIPVKSGGPHGAGVLGLHLEGPFISREKRGAHPEAHLRSFEADAFQDLLATYGPLDNVRIVTLAPELGRSHEVIRALTARGICVSLGHSVADLRAAEDAVWSGATFITHLFNAMLPFHHRDPGIVGLLTSDRLPAGRCIFYGMIADGTHTNPAALRIAHRAHPQGLVLVTDAIPALGLGNGRHTLGQQEVEVDGLTAYVAGERPDPLGPRSQPACQVAHDPPRACPLCSQGTKTLSGSIAPMDVCVRHFLQATGCSMESALEAASLHPAQLLGLEKSKGTLDFGADADFVVLDDSLHVQATYISGELVWQADAARQ

SEQ ID NO: 1386 - protein, 556 aa, Homo sapiens
MARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQARANSFVGTAQYVSPELLTEKSACKSSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNYDNLLSQFGCMQVSSSSSSHSLSASDTGLPQRSGSNIEQYIHDLDSNSFELDLQFSEDEKRLLLEKQAGGNPWHQFVENNLILKMGPVDKRKGLFARRRQLLLTEGPHLYYVDPVNKVLKGEIPWSQELRPEAKNFKTFFVHTPNRTYYLMDPSGNAHKWCRKIQEVWRQRYQSHPDAAVQ

SEQ ID NO: 1387 - protein, 556 aa, Homo sapiens; identical to SEQ ID NO: 1386

SEQ ID NO: 1388 - protein, 2752 aa, Homo sapiens
MYNGIGLPTPRGSGTNGYVQRNLSLVRGRRGERPDYKGEEELRRLEAALVKRPNPDILDHERKRRVELRCLELEEMMEEQGYEEQQIQEKVATFRLMLLEKDVNPGGKEETPGQRPAVTETHQLAELNEKKNERLRAAFGISDSYVDGSSFDPQRRAREAKQPAPEPPKPYSLVRESSSSRSPTPKQKKKKKKKDRGRRSESSSPRRERKKSSKKKKHRSESESKKRKHRSPTPKSKRKSKDKKRKRSRSTTPAPKSRRAHRSTSADSASSSDTSRSRSRSAAAKTHTTALAGRSPSPASGRRGEGDAPFSEPGTTSTQRPSSPETATKQPSSPYEDKDKDKKEKSATRPSPSPERSSTGPEPPAPTPLLAERHGGSPQPLATTPLSQEPVNPPSEASPTRDRSPPKSPEKLPQSSSSESSPPSPQPTKVSRHASSSPESPKPAPAPGSHREISSSPTSKNRSHGRAKRDKSHSHTPSRRMGRSRSPATAKRGRSRSRTPTKRGHSRSRSPQWRRSRSAQRWGRSRSPQRRGRSRSPQRPGWSRSRNTQRRGRSRSARRGRSHSRSPATRGRSRSRTPARRGRSRSRTPARRRSRSRTPTRRRSRSRTPARRGRSRSRTPARRRSRTRSPVRRRSRSRSPARRSGRSRSRTPARRGRSRSRTPARRGRSRSRTPARRSGRSRSRTPARRGRSRSRTPRRGRSRSRSLVRRGRSHSRTPQRRGRSGSSSERKNKSRTSQRRSRSNSSPEMKKSRISSRRSRSLSSPRSKAKSRLSLRRSLSGSSPCPKQKSQTPPRRSRSGSSQPKAKSRTPPRRSRSSSSPPPKQKSKTPSRQSHSSSSPHPKVKSGTPPRQGSITSPQANEQSVTPQRRSCFESSPDPELKSRTPSRHSCSGSSPPRVKSSTPPRQSPSRSSSPQPKVKAIISPRQRSHSGSSSPSPSRVTSRTTPRRSRSVSPCSNVESRLLPRYSHSGSSSPDTKVKPETPPRQSHSGSISPYPKVKAQTPPGPSLSGSKSPCPQEKSKDSLVQSCPGSLSLCAGVKSSTPPGESYFGVSSLQLKGQSQTSPDHRSDTSSPEVRQSHSESPSLQSKSQTSPKGGRSRSSSPVTELASRSPIRQDRGEFSASPMLKSGMSPEQSRFQSDSSSYPTVDSNSLLGQSRLETAESKEKMALPPQEDATASPPRQKDKFSPFPVQDRPESSLVFKDTLRTPPRERSGAGSSPETKEQNSALPTSSQDEELMEVVEKSEEPAGQILSHLSSELKEMSTSNFESSPEVEERPAVSLTLDQSQSQASLEAVEVPSMASSWGGPHFSPEHKELSNSPLRENSFGSPLEFRNSGPLGTEMNTGFSSEVKEDLNGPFLNQLETDPSLDMKEQSTRSSGHSSSELSPDAVEKAGMSSNQSISSPVLDAVPRTPSRERSSSASSPEMKDGLPRTPSRRSRSGSSPGLRDGSGTPSRHSLSGSSPGMKDIPRTPFRGRSECDSSPEPKALPQTPRPRSRSPSSPELNNKCLTPQRERSGSESSVDQKTVARTPLGQRSRSGSSQELDVKPSASPQERSESDSSPDSKAKTRTPLRQRSRSGSSPEVDSKSRLSPRRSRSGSSPEVKDKPRAAPRAQSGSDSSPEPKAPAPRALPRRSRSGSSSKGRGPSPEGSSSTESSPEHPPKSRTARRGSRSSPEPKTKSRTPPRRRSSRSSPELTRKARLSRRSRSASSSPETRSRTPPRHRRSPSVSSPEPAEKSRSSRRRRSASSPRTKTTSRRGRSPSPKPRGLQRSRSRSRREKTRTTRRRDRSGSSQSTSRRRQRSRSRSRVTRRRRGGSGYHSRSPARQESSRTSSRRRRGRSRTPPTSRKRSRSRTSPAPWKRSRSRASPATHRRSRSRTPLISRRRSRSRTSPVSRRRSRSRTSVTRRRSRSRASPVSRRRSRSRTPPVTRRRSRSRTPTTRRRSRSRTPPVTRRRSRSRTPPVTRRRSRSRTSPITRRRSRSRTSPVTRRRSRSRTSPVTRRRSRSRTSPVTRRRSRSRTPPAIRRRSRSRTPLLPRKRSRSRSPLAIRRRSRSRTPRTARGKRSLTRSPPAIRRRSASGSSSDRSRSATPPATRNHSGSRTPPVALNSSRMSCFSRPSMSPTPLDRCRSPGMLEPLGSSRTPMSVLQQAGGSMMDGPGPRIPDHQRTSVPENHAQSRIALALTAISLGTARPPPSMSAAGLAARMSQVPAPVPLMSLRTAPAANLASRIPAASAAAMNLASARTPAIPTAVNLADSRTPAAAAAMNLASPRTAVAPSAVNLADPRTPTAPAVNLAGARTPAALAALSLTGSGTPPTAANYPSSSRTPQAPASANLVGPRSAHATAPVNIAGSRTAAALAPASLTSARMAPALSGANLTSPRVPLSAYERVSGRTSPPLLDRARSRTPPSAPSQSRMTSERAPSPSSRMGQAPSQSLLPPAQDQPRSPVPSAFSDQSRCLIAQTTPVAGSQSLSSGAVATTTSSAGDHNGMLSVPAPGVPHSDVGEPPASTGAQQPSALAALQPAKERRSSSSSSSSSSSSSSSSSSSSSSSSSGSSSSDSEGSSLPVQPEVALKRVPSPTPAPKEAVREGRPPEPTPAKRKRRSSSSSSSSSSSSSSSSSSSSSSSSSSSSSSSSSSSSSSSSSSPSPAKPGPQALPKPASPKKPPPGERRSRSPRKPIDSLRDSRSLSYSPVERRRPSPQPSPRDQQSSSSERGSRRGQRGDSRSPSHKRRRETPSPRPMRHRSSRSP

SEQ ID NO: 1389 - protein, 2752 aa, Homo sapiens; identical to SEQ ID NO: 1388

SEQ ID NO: 1390 - protein, 887 aa, Homo sapiens
MGEAEKFHYIYSCDLDINVQLKIGSLEGKREQKSYKAVLEDPMLKFSGLYQETCSDLYVTCQVFAEGKPLALPVRTSYKAFSTRWNWNEWLKLPVKYPDLPRNAQVALTIWDVYGPGKAVPVGGTTVSLFGKYGMFRQGMHDLKVWPNVEADGSEPTKTPGRTSSTLSEDQMSRLAKLTKAHRQGHMVKVDWLDRLTFREIEMINESEKRSSNFMYLMVEFRCVKCDDKEYGIVYYEKDGDESSPILTSFELVKVPDPQMSMENLVESKHHKLARSLRSGPSDHDLKPNAATRDQLNIIVSYPPTKQLTYEEQDLVWKFRYYLTNQEKALTKFLKCVNWDLPQEAKQALELLGKWKPMDVEDSLELLSSHYTNPTVRRYAVARLRQADDEDLLMYLLQLVQALKYENFDDIKNGLEPTKKDSQSSVSENVSNSGINSAEIDSSQIITSPLPSVSSPPPASKTKEVPDGENLEQDLCTFLISRACKNSTLANYLYWYVIVECEDQDTQQRDPKTHEMYLNVMRRFSQALLKGDKSVRVMRSLLAAQQTFVDRLVHLMKAVQRESGNRKKKNERLQALLGDNEKMNLSDVELIPLPLEPQVKIRGIIPETATLFKSALMPAQLFFKTEDGGKYPVIFKHGDDLRQDQLILQIISLMDKLLRKENLDLKLTPYKVLATSTKHGFMQFIQSVPVAEVLDTEGSIQNFFRKYAPSENGPNGISAEVMDTYVKSCAGYCVITYILGVGDRHLDNLLLTKTGKLFHIDFGYILGRDPKPLPPPMKLNKEMVEGMGGTQSEQYQEFRKQCYTAFLHLRRYSNLILNLFSLMVDANIPDIALEPDKTVKKVQDKFRLDLSDEEAVHYMQSLIDESVHALFAAVVEQIHKFAQYWRK

SEQ ID NO: 1391 - protein, 553 aa, Homo sapiens
MLSVRVAAAVVRALPRRAGLVSRNALGSSFIAARNFHASNTHLQKTGTAEMSSILEERILGADTSVDLEETGRVLSIGDGIARVHGLRNVQAEEMVEFSSGLKGMSLNLEPDNVGVVVFGNDKLIKEGDIVKRTGAIVDVPVGEELLGRVVDALGNAIDGKGPIGSKTRRRVGLKAPGIIPRISVREPMQTGIKAVDSLVPIGRGQRELIIGDRQTGKTSIAIDTIINQKRFNDGSDEKKKLYCIYVAIGQKRSTVAQLVKRLTDADAMKYTIVVSATASDAAPLQYLAPYSGCSMGEYFRDNGKHALIIYDDLSKQAVAYRQMSLLLRRPPGREAYPGDVFYLHSRLLERAAKMNDAFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLSRGVRLTELLKQGQYSPMAIEEQVAVIYAGVRGYLDKLEPSKITKFENAFLSHVVSQHQALLGTIRADGKISEQSDAKLKEIVTNFLAGFEA

SEQ ID NO: 1392 - protein, 621 aa, Homo sapiens
MADFEELRNMVSSFRVSELQVLLGFAGRNKSGRKHDLLMRALHLLKSGCSPAVQIKIRELYRRRYPRTLEGLSDLSTIKSSVFSLDGGSSPVEPDLAVAGIHSLPSTSVTPHSPSSPVGSVLLQDTKPTFEMQQPSPPIPPVHPDVQLKNLPFYDVLDVLIKPTSLVQSSIQRFQEKFFIFALTPQQVREICISRDFLPGGRRDYTVQVQLRLCLAETSCPQEDNYPNSLCIKVNGKLFPLPGYAPPPKNGIEQKRPGRPLNITSLVRLSSAVPNQISISWASEIGKNYSMSVYLVRQLTSAMLLQRLKMKGIRNPDHSRALIKEKLTADPDSEIATTSLRVSLMCPLGKMRLTIPCRAVTCTHLQCFDAALYLQMNEKKPTWICPVCDKKAAYESLILDGLFMEILNDCSDVDEIKFQEDGSWCPMRPKKEAMKVSSQPCTKIESSSVLSKPCSVTVASEASKKKVDVIDLTIESSSDEEEDPPAKRKCIFMSETQSSPTKGVLMYQPSSVRVPSVTSVDPAAIPPSLTDYSVPFHHTPISSMSSDLPGLDFLSLIPVDPQYCPPMFLDSLTSPLTASSTSVTTTSSHESSTHVSSSSSRSETGVITSSGSNIPEIISLD

SEQ ID NO: 1393 - protein, 572 aa, Homo sapiens
MADFEELRNMVSSFRVSELQVLLGFAGRNKSGRKHDLLMRALHLLKSGCSPAVQIKIRELYRRRYPRTLEGLSDLSTIKSSVFSLDGGSSPVEPDLAVAGIHSLPSTSVTPHSPSSPVGSVLLQDTKPTFEMQQPSPPIPPVHPDVQLKNLPFYDVLDVLIKPTSLVQSSIQRFQEKFFIFALTPQQVREICISRDFLPGGRRDYTVQVQLRLCLAETSCPQEDNYPNSLCIKVNGKLFPLPGYAPPPKNGIEQKRPGRPLNITSLVRLSSAVPNQISISWASEIGKNYSMSVYLVRQLTSAMLLQRLKMKGIRNPDHSRALIKEKLTADPDSEIATTSLRVSLMCPLGKMRLTIPCRAVTCTHLQCFDAALYLQMNEKKPTWICPVCDKKAAYESLILDGLFMEILNDCSDVDEIKFQEDGSWCPMRPKKEAMKVSSQPCTKIESSSVLSKPCSVTVASEASKKKVDVIDLTIESSSDEEEDPPAKRKCIFMSETQSSPTKGVLMYQPSSVRVPSVTSVDPAAIPPSLTDYSVPFHHTPISSMSSDLPGEQRRNDINNELKLGTSSDTVQQ

SEQ ID NO: 1394 - protein, 621 aa, Homo sapiens; identical to SEQ ID NO: 1392

SEQ ID NO: 1395 - protein, 572 aa, Homo sapiens; identical to SEQ ID NO: 1393

SEQ ID NO: 1396 - protein, 82 aa, Homo sapiens
MAFTLYSLLQAALLCVNAIAVLHEERFLKNIGWGTDQGIGGFGEEPGIKSQLMNLIRSVRTVMRVPLIIVNSIAIVLLLLFG

SEQ ID NO: 1397 - protein, 535 aa, Homo sapiens
MKKISLKTLRKSFNLNKSKEETDFMVVQQPSLASDFGKDDSLFGSCYGKDMASCDINGEDEKGGKNRSKSESLMGTLKRRLSAKQKSKGKAGTPSGSSADEDTFSSSSAPIVFKDVRAQRPIRSTSLRSHHYSPAPWPLRPTNSEETCIKMEVRVKALVHSSSPSPALNGVRKDFHDLQSETTCQEQANSLKSSASHNGDLHLHLDEHVPVVIGLMPQDYIQYTVPLDEGMYPLEGSRSYCLDSSSPMEVSAVPPQVGGRAFPEDESQVDQDLVVAPEIFVDQSVNGLLIGTTGVMLQSPRAGHDDVPPLSPLLPPMQNNQIQRNFSGLTGTEAHVAESMRCHLNFDPNSAPGVARVYDSVQSSGPMVVTSLTEELKKLAKQGWYWGPITRWEAEGKLANVPDGSFLVRDSSDDRYLLSLSFRSHGKTLHTRIEHSNGRFSFYEQPDVEGHTSIVDLIEHSIRDSENGAFCYSRSRLPGSATYPVRLTNPVSRFMQVRSLQYLCRFVIRQYTRIDLIQKLPLPNKMKDYLQEKHY

SEQ ID NO: 1398 - protein, 186 aa, Homo sapiens
MASQKRPSQRHGSKYLATASTMDHARHGFLPRHRDTGILDSIGRFFGGDRGAPKRGSGKVPWLKPGRSPLPSHARSQPGLCNMYKDSHHPARTAHYGSLPQKSHGRTQDENPVVHFFKNIVTPRTPPPSQGKGAEGQRPGFGYGGRASDYKSAHKGFKGVDAQGTLSKIFKLGGRDSRSGSPMARR

SEQ ID NO: 1399 - protein, 825 aa, Homo sapiens
MPSTSFPVPSKFPLGPAAAVFGRGETLGPAPRAGGTMKSAEEEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQ

SEQ ID NO: 1400 - protein, 930 aa, Homo sapiens
MTGLEDQEFDFEFLFEFNQRDEGAAAAAPEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQVSAPPSSSCPPGLEHSLCPSSPSPPLPPATQEPTCLQPCSPACPPATGRPQHLPSTVRRDESPTAGPRLLPEVHEDGSPNLAPIPVTVKREPEELDQLYLDDVNEIIRNDLSSTSTHS

SEQ ID NO: 1401 - protein, 353 aa, Homo sapiens
MLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQ

SEQ ID NO: 1402 - protein, 812 aa, Homo sapiens
MTGLEDQEFDFEFLFEFNQRDEGAAAAAPEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQ

SEQ ID NO: 1403 - protein, 716 aa, Homo sapiens
MPSTSFPVPSKFPLGPAAAVFGRGETLGPAPRAGGTMKSAEEEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANGNAIFLTVSREHERVGCFF

SEQ ID NO: 1404 - protein, 961 aa, Homo sapiens
MEVPAAGRVPAEGAPTAAVAEVRCPGPAPLRLLEWRVAAGAAVRIGSVLAVFEAAASAQSAGASQSRVASGGCVRPARPERRLRSERAGVVRELCAQPGQVVAPGAVLVRLEGCSHPVVMKGLCAECGQDLTQLQSKNGKQQVPLSTATVSMVHSVPELMVSSEQAEQLGREDQQRLHRNRKLVLMVDLDQTLIHTTEQHCQQMSNKGIFHFQLGRGEPMLHTRLRPHCKDFLEKIAKLYELHVFTFGSRLYAHTIAGFLDPEKKLFSHRILSRDECIDPFSKTGNLRNLFPCGDSMVCIIDDRKDVWKFAPNLITVKKYVYFQGTGDMNAPPGSRESQTRKKVNHSRGTEVSEPSPPVRDPEGVTQAPGVEPSNGLEKPARELNGSEAATPRDSPRPGKPDERDIWPPAQAPTSSQELAGAPEPQGSCAQGGRVAPGQRPAQGATGTDLDFDLSSDSESSSESEGTKSSSSASDGESEGKRGRQKPKAAPEGAGALAQGSSLEPGRPAAPSLPGEAEPGAHAPDKEPELGGQEEGERDGLCGLGNGCADRKEAETESQNSELSGVTAGESLDQSMEEEEEEDTDEDDHLIYLEEILVRVHTDYYAKYDRYLNKEIEEAPDIRKIVPELKSKVLADVAIIFSGLHPTNFPIEKTREHYHATALGAKILTRLVLSPDAPDRATHLIAARAGTEKVLQAQECGHLHVVNPDWLWSCLERWDKVEEQLFPLRDDHTKAQRENSPAAFPDREGVPPTALFHPMPVLPKAQPGPEVRIYDSNTGKLIRTGARGPPAPSSSLPIRQEPSSFRAVPPPQPQMFGEELPDAQDGEQPGPSRRKRQPSMSETMPLYTLCKEDLESMDKEVDDILGEGSDDSDSEKRRPEEQEEEPQPRKPGTRRGADARAPASSERSAAGGRGPRGHKRKLNEEDAASESSRESSNEDEGSSSEADEMAKALEAELNDLM

SEQ ID NO: 1405 - protein, 867 aa, Homo sapiens
MEVPAAGRVPAEGAPTAAVAEVRCPGPAPLRLLEWRVAAGAAVRIGSVLAVFEAAASAQSAGASQSRVASGGCVRPARPERRLRSERAGVVRELCAQPGQVVAPGAVLVRLEGCSHPVVMKGLCAECGQDLTQLQSKNGKQQVPLSTATVSMVHSVPELMVSSEQAEQLGREDQQRLHRNRKLVLMVDLDQTLIHTTEQHCQQMSNKGIFHFQLGRGEPMLHTRLRPHCKDFLEKIAKLYELHVFTFGSRLYAHTIAGFLDPEKKLFSHRILSRDECIDPFSKTGNLRNLFPCGDSMVCIIDDRKDVWKFAPNLITVKKYVYFQGTGDMNAPPGSRESQTRKKVNHSRGTEVSEPSPPVRDPEGVTQAPGVEPSNGLEKPARELNGSEAATPRDSPRPGKPDERDIWPPAQAPTSSQELAGAPEPQGSCAQGGRVAPGQRPAQGATGTDLDFDLSSDSESSSESEGTKSSSSASDGESEGKRGRQKPKAAPEGAGALAQGSSLEPGRPAAPSLPGEAEPGAHAPDKEPELGGQEEGERDGLCGLGNGCADRKEAETESQNSELSGVTAGESLDQSMEEEEEEDTDEDDHLIYLEEILVRVHTDYYAKYDRYLNKEIEEAPDIRKIVPELKSKVLADVAIIFSGLHPTNFPIEKTREHYHATALGAKILTRLVLSPDAPDRATHLIAARAGTEKVLQAQECGHLHVVNPDWLWSCLERWDKVEEQLFPLRDDHTKAQRENSPAAFPDREGVPPTALFHPMPVLPKAQPGPEVRIYDSNTGKLIRTGARGPPAPSSSLPIRQEPSSFRWTTSLEKAATTATARRGGLRSRRRSPSPGSQGPAGERTLGHLRPARGARQGAGGPEATRGS

SEQ ID NO: 1406 - protein, 271 aa, Homo sapiens
MEAEGLDWLLVPLHQLVSWGAAAAMVFGGVVPYVPQYRDIRRTQNADGFSTYVCLVLLVANILRILFWFGRRFESPLLWQSAIMILTMLLMLKLCTEVRVANELNARRRSFTAADSKDEEVKVAPRRSFLDFDPHHFWQWSSFSDYVQCVLAFTGVAGYITYLSIDSALFVETLGFLAVLTEAMLGVPQLYRNHRHQSTEGMSIKMVLMWTSGDAFKTAYFLLKGAPLQFSVCGLLQVLVDLAILGQAYAFARHPQKPAPHAVHPTGTKAL

SEQ ID NO: 1407 - protein, 142 aa, Homo sapiens
MSYMLPHLHNGWQVDQAILSEEDRVVVIRFGHDWDPTCMKMDEVLYSIAEKVKNFAVIYLVDITEVPDFNKMYELYDPCTVMFFFRNKHIMIDLGTGNNNKINWAMEDKQEMVDIIETVYRGARKGRGLVVSPKDYSTKYRY

SEQ ID NO: 1408 - protein, 343 aa, Homo sapiens
MWAAAGGLWRSRAGLRALFRSRDAALFPGCERGLHCSAVSCKNWLKKFASKTKKKVWYESPSLGSHSTYKPSKLEFLMRSTSKKTRKEDHARLRALNGLLYKALTDLLCTPEVSQELYDLNVELSKVSLTPDFSACRAYWKTTLSAEQNAHMEAVLQRSAAHMRHLLMSQQTLRNVPPIVFVQDKGNAALAELDQLLAVADFGPRDERDNFVQNDFRDPDAPQPCGTTEPTTSSSLCGIDHEALNKQIMEYKRRKDKGLGGLVWQGQVAELTTQMQKGRKRAKPRLEQDSSLKSYLSGEEVEDDLDLVGAPEYECYAPDTEELEAERGGGRTEDGHSCGASRE

SEQ ID NO: 1409 - protein, 1262 aa, Homo sapiens
MKNSAKGELPDAKSPWWEMDDHRGCSSHPFHAVWQTMVQPGLRAAHITYTAPSAVGERPLKMRRQGLLPGRWAGVLRPGGPSRWSCCILWTMNTNAAVAVPGLCVLNAFLPCGSHLPSGASESEFSMKISKMFQIPVENLDNIRKVRKKVKGILVDIGLDSCKELLKDLKGFDPGEKYFHNTSWGDVSLWEPSGKKVRYRTKPYCCGLCKYSTKVLTSFKNHLHRYHEDEIDQELVIPCPNCVFASQPKVVGRHFRMFHAPVRKVQNYTVNILGETKSSRSDVISFTCLKCNFSNTLYYSMKKHVLVAHFHYLINSYFGLRTEEMGEQPKTNDTVSIEKIPPPDKYYCKKCNANASSQDALMYHILTSDIHRDLENKLRSVISEHIKRTGLLKQTHIAPKPAAHLAAPANGSAPSAPAQPPCFHLALPQNSPSPAAGQPVTVAQGAPGSLTHSPPAAGQSHMTLVSSPLPVGQNSLTLQPPAPQPVFLSHGVPLHQSVNPPVLPLSQPVGPVNKSVGTSVLPINQTVRPGVLPLTQPVGPINRPVGPGVLPVSPSVTPGVLQAVSPGVLSVSRAVPSGVLPAGQMTPAGQMTPAGVIPGQTATSGVLPTGQMVQSGVLPVGQTAPSRVLPPGQTAPLRVISAGQVVPSGLLSPNQTVSSSAVVPVNQGVNSGVLQLSQPVVSGVLPVGQPVRPGVLQLNQTVGTNILPVNQPVRPGASQNTTFLTSGSILRQLIPTGKQVNGIPTYTLAPVSVTLPVPPGGLATVAPPQMPIQLLPSGAAAPMAGSMPGMPSPPVLVNAAQSVFVQASSSAADTNQVLKQAKQWKTCPVCNELFPSNVYQVHMEVAHKHSESKSGEKLEPEKLAACAPFLKWMREKTVRCLSCKCLVSEEELIHHLLMHGLGCLFCPCTFHDIKGLSEHSRNRHLGKKKLPMDYSNRGFQLDVDANGNLLFPHLDFITILPKEKLGEREVYLAILAGIHSKSLVPVYVKVRPQAEGTPGSTGKRVSTCPFCFGPFVTTEAYELHLKERHHIMPTVHTVLKSPAFKCIHCCGVYTGNMTLAAIAVHLVRCRSAPKDSSSDLQAQPGFIHNSELLLVSGEVMHDSSFSVKRKLPDGHLGAEDQRHGEEQPPILNADAAPGPEKVTSVVPFKRQRNESRTEGPIVKDEALQILALDPKKYEGRSYEEKKQFLKDYFHKKPYPSKKEIELLSSLFWVWKIDVASFFGKRRYICMKAIKNHKPSVLLGFDMSELKNVKHRLNFEYEP

SEQ ID NO: 1410 - protein, 348 aa, Homo sapiens
MSLLFVSMACVGFFLLQGAWPHEGVHRKPSLLAHPGPLVKSEETVILQCWSDVMFEHFLLHREGMFNDTLRLIGEHHDGVSKANFSISRMTQDLAGTYRCYGSVTHSPYQVSAPSDPLDIVIIGLYEKPSLSAQPGPTVLAGENVTLSCSSRSSYDMYHLSREGEAHERRLPAGPKVNGTFQADFPLGPATHGGTYRCFGSFHDSPYEWSKSSDPLLVSVTGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCP

SEQ ID NO: 1411 - protein, 304 aa, Homo sapiens
MSSTLPALLCVGLCLSQRISAQQQTLPKPFIWAEPHFMVPKEKQVTICCQGNYGAVEYQLHFEGSLFAVDRPKPPERINKVKFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPADTWGTYLLTTETGLQKDHALWDHTAQNLLRMGLAFLVLVALVWFLVEDWLSRKRTRERASRASTWEGRRRLNTQTL

SEQ ID NO: 1412 - protein, 103 aa, Homo sapiens
MSEEKPKEGVKTENDHINLKVAGQDGSVVQFKIKRHTSLSKLMKAYCERQGLSMRQIRFRFDGQPINETDTPAQLRMEDEDTIDVFQQQTGGVPESSLAGHSF

SEQ ID NO: 1413 - protein, 180 aa, Homo sapiens
MAPGVARGPTPYWRLRLGGAALLLLLIPVAAAQEPPGAACSQNTNKTCEECLKNVSCLWCNTNKACLDYPVTSVLPPASLCKLSSARWGVCWVNFEALIITMSVVGGTLLLGIAICCCCCCRRKRSRKPDRSEEKAMREREERRIRQEERRAEMKTRHDEIRKKYGLFKEENPYARFENN

SEQ ID NO: 1414 - protein, 433 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLFEFMIESILYARDAWLKEDGVIWPTMAALHLVPCSADKDYRSKVLFWDNAYEFNLSALKSLAVKEFFSKPKYNHILKPEDCLSEPCTILQLDMRTVQISDLETLRGELRFDIRKAGTLHGFTAWFSVHFQSLQEGQPPQVLSTGPFHPTTHWKQTLFMMDDPVPVHTGDVVTGSVVLQRNPVWRRHMSVALSWAVTSRQDPTSQKVGEKVFPIWR

SEQ ID NO: 1415 - protein, 428 aa, Homo sapiens
MDSLWGPGAGSHPFGVHNTRLSPDLCPGKIVLRALKESGAGMPEQDKDPRVQENPGDQRRVPEVTGDAPSAFRPLRDNGGLSPFVPGPGPLQTDLHAQRSEIRYNQTSQTSWTSSCTNRNAISSSYSSTGGLPGLKRRRGPASSHCQLTLSSSKTVSEDRPQAVSSGHTQCEKAADIAPGQTLTLRNDSSTSEASRPSTHKFPLLPCRRGEPLMLPPPLELGYRVTVEDLDREKEAAFQRINSALQVEDKAISDCRPSRPSHTLSSLATGASGLPAVSKAPSMDAQQETHKSQDCLGLLAPLASAAEVPSTAPMSGKKHRPPGPLFSSSDPLPATSSHSQDSAQVTSLIPAPFPAASMDAGMRRTRRGTSAPAAAAAAPPPSALNPTLGSLLEWMEALHISGPQPQLQQVPRGQNQRSQTSRTSSCPK

SEQ ID NO: 1416 - protein, 333 aa, Homo sapiens
MVIAGASWMLGRAAASPTQTPPTTSTIRVARRSRVALVAMVIAAAGSGGPGRAEPQLSQPSLDCGRMRSSLTPLGPPVSRDRVIASFPKWYTPEACLQLREHFHGQVSAACQRRNTGTVGLKLSKVVVVGDLYVGKTSLIHRFCKNVFDRDYKATIGVDFEIERFEIAGIPYSLQIWDTAGQEKFKCIASAYYRGAQVIITAFDLTDVQTLEHTRQWLEDALRENEAGSCFIFLVGTKKDLLSGAACEQAEADAVHLAREMQAEYWSVSAKTGENVKAFFSRVAALAFEQSVLQDLERQSSARLQVGNGDLIQMEGSPPETQESKRPSSLGCC

SEQ ID NO: 1417 - protein, 1271 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSHLEALLLPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEHRQLLKDSFMVELVEGARKLRHVFLFTELLLCTKLKKQSGGKTQQYDCKWYIPLTDLSFQMVDELEAVPNIPLVPDEELDALKIKISQIKSDIQREKRANKGSKATERLKKKLSEQESLLLLMSPSMAFRVHSRNGKSYTFLISSDYERAEWRENIREQQKKCFRSFSLTSVELQMLTNSCVKLQTVHSIPLTINKEDDESPGLYGFLNVIVHSATGFKQSSNLYCTLEVDSFGYFVNKAKTRVYRDTAEPNWNEEFEIELEGSQTLRILCYEKCYNKTKIPKEDGESTDRLMGKGQVQLDPQALQDRDWQRTVIAMNGIEVKLSVKFNSREFSLKRMPSRKQTGVFGVKIAVVTKRERSKVPYIVRQCVEEIERRGMEEVGIYRVSGVATDIQALKAAFDVNNKDVSVMMSEMDVNAIAGTLKLYFRELPEPLFTDEFYPNFAEGIALSDPVAKESCMLNLLLSLPEANLLTFLFLLDHLKRVAEKEAVNKMSLHNLATVFGPTLLRPSEKESKLPANPSQPITMTDSWSLEVMSQVQVLLYFLQLEAIPAPDSKRQSILFSTEV

SEQ ID NO: 1418 - protein, 1227 aa, Homo sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGIMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDDEGAFHGDADGSFGTPPGYGCAADRAEEQRRHQDGLPYIDDSPSSSPHLSSKGRGSRDALVSGALKSTKASELDLEKGLEMRKWVLSGILASEETYLSHLEALLLPMKPLKAAATTSQPVLTSQQIETIFFKVPELYEIHKESYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEHRQLLKDSFMVELVEGARKLRHVFLFTDLLLCTKLKKQSGGKTQQYDCKWYIPLTDLSFQMVDELEAVPNIPLVPDEELDALKIKISQIKSDIQREKRANKGSKATERLKKKLSEQESLLLLMSPSMAFRVHSRNGKSYTFLISSDYERAEWRENIREQQKKCFRSFSLTSVELQMLTNSCVKLQTVHSIPLTINKEDDESPGLYGFLNVIVHSATGFKQSSNLYCTLEVDSFGYFVNKAKTRVYRDTAEPNWNELDPQALQDRDWQRTVIAMNGIEVKLSVKFNSREFSLKRMPSRKQTGVFGVKIAVVTKRERSKVPYIVRQCVEEIERRGMEEVGIYRVSGVATDIQALKAAFDVNNKDVSVMMSEMDVNAIAGTLKLYFRELPEPLFTDEFYPNFAEGIALSDPVAKESCMLNLLLSLPEANLLTFLFLLDHLKRVAEKEAVNKMSLHNLATVFGPTLLRPSEKESKLPANPSQPITMTDSWSLEVMSQVQVLLYFLQLEAIPAPDSKRQSILFSTEV

SEQ ID NO: 1419 - protein, 213 aa, Homo sapiens
MRPGTGQGGLEAPGEPGPNLRQRWPLLLLGLAVVTHGLLRPTAASQSRALGPGAPGGSSRSSLRSRWGRFLLQRGSWTGPRCWPRGFQSKHNSVTHVFGSGTQLTVLSQPKATPSVTLFPPSSEELQANKATLVCLMNDFYPGILTVTWKADGTPITQGVEMTTPSKQSNNKYAASSYLSLTPEQWRSRRSYSCQVMHEGSTVEKTVAPAECS

SEQ ID NO: 1420 - protein, 84 aa, Homo sapiens
MRPGTGQGGLEAPGEPGPNLRQRWPLLLLGLAVVTHGLLRPTAASQSRALGPGAPGGSSRSSLRSRWGRSAQGHPLGHSVPAVL

SEQ ID NO: 1421 - protein, 488 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGAQYWVYDGEKPVLGPAPLTELGLVRFPVHAALVWGPEKNKIYFFRGRDYWRFHPSTRRVDSPVPRRATDWRGVPSEIDAAFQDADGYAYFLRGRLYWKFDPVKVKALEGFPRLVGPDFFGCAEPANTFL

SEQ ID NO: 1422 - protein, 385 aa, Homo sapiens
MMMMALSKTFGQKPVKFQLEDDGEFYMIGSEVGNYLRMFRGSLYKRYPSLWRRLATVEERKKIVASSHGKKTKPNTKDHGYTTLATSVTLLKASEVEEILDGNDEKYKAVSISTEPPTYLREQKAKRNSQWVPTLPNSSHHLDAVPCSTTINRNRMGRDKKRTFPLCFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDAEMEKKIRDQDRNTRRMRRLANTAPAW

SEQ ID NO: 1423 - protein, 240 aa, Homo sapiens; identical to SEQ ID NO: 1175

SEQ ID NO: 1424 - protein, 126 aa, Homo sapiens
MSIGVPIKVLHEAEGHIVTCETNTGEVYRGKLIEAEDNMNCQMSNITVTYRDGRVAQLEQVYIRGSKIRFLILPDMLKNAPMLKSMKNKNQGSGAGRGKAAILKAQVAARGRGRGMGRGNIFQKRR

SEQ ID NO: 1425 - protein, 708 aa, Homo sapiens
MATSTSTEAKSASWWNYFFLYDGSKVKEEGDPTRAGICYFYPSQTLLDQQELLCGQIAGVVRCVSDISDSPPTLVRLRKLKFAIKVDGDYLWVLGCAVELPDVSCKRFLDQLVGFFNFYNGPVSLAYENCSQEELSTEWDTFIEQILKNTSDLHKIFNSLWNLDQTKVEPLLLLKAARILQTCQRSPHILAGCILYKGLIVSTQLPPSLTAKVLLHRTAPQEQRLPTGEDAPQEHGAALPPNVQIIPVFVTKEEAISLHEFPVEQMTRSLASPAGLQDGSAQHHPKGGSTSALKENATGHVESMAWTTPDPTSPDEACPDGRKENGCLSGHDLESIRPAGLHNSARGEVLGLSSSLGKELVFLQEELDLSEIHIPEAQEVEMASGHFAFLHVPVPDGRAPYCKASLSASSSLEPTPPEDTAISSLRPPSAPEMLTQHGAQEQLEDHPGHSSQAPIPRADPLPRRTRRPLLLPRLDPGQRGNKLPTGEQGLDEDVDGVCESHAAPGLECSSGSANCQGAGPSADGISSRLTPAESCMGLVRMNLYTHCVKGLVLSLLAEEPLLGDSAAIEEVYHSSLASLNGLEVHLKETLPRDEAASTSSTYNFTHYDRIQSLLMANLPQVATPQDRRFLQAVSLMHSEFAQLPALYEMTVRNASTAVYACCNPIQETYFQQLAPAARSSGFPNPQDGAFSLSGKAKQKLLKHGVNLL

SEQ ID NO: 1426 - protein, 196 aa, Homo sapiens
MATSTSTEAKSASWWNYFFLYDGSKVKEEGDPTRAGICYFYPSQTLLDQQELLCGQIAGVVRCVSDISDSPPTLVRLRKLKFAIKVDGDYLWVLGCAVELPDVSCKRFLDQLVGFFNFYNGPVSLAYENCSQEELSTEWDTFIEQILKNTSDLHKIFNSLWNLDQTKALSYTLSSCSVQPFPLFSLPDCEHADGWA

SEQ ID NO: 1427 - protein, 703 aa, Homo sapiens
MAPLCSLARWNYFFLYDGSKVKEEGDPTRAGICYFYPSQTLLDQQELLCGQIAGVVRCVSDISDSPPTLVRLRKLKFAIKVDGDYLWVLGCAVELPDVSCKRFLDQLVGFFNFYNGPVSLAYENCSQEELSTEWDTFIEQILKNTSDLHKIFNSLWNLDQTKVEPLLLLKAARILQTCQRSPHILAGCILYKGLIVSTQLPPSLTAKVLLHRTAPQEQRLPTGEDAPQEHGAALPPNVQIIPVFVTKEEAISLHEFPVEQMTRSLASPAGLQDGSAQHHPKGGSTSALKENATGHVESMAWTTPDPTSPDEACPDGRKENGCLSGHDLESIRPAGLHNSARGEVLGLSSSLGKELVFLQEELDLSEIHIPEAQEVEMASGHFAFLHVPVPDGRAPYCKASLSASSSLEPTPPEDTAISSLRPPSAPEMLTQHGAQEQLEDHPGHSSQAPIPRADPLPRRTRRPLLLPRLDPGQRGNKLPTGEQGLDEDVDGVCESHAAPGLECSSGSANCQGAGPSADGISSRLTPAESCMGLVRMNLYTHCVKGLVLSLLAEEPLLGDSAAIEEVYHSSLASLNGLEVHLKETLPRDEAASTSSTYNFTHYDRIQSLLMANLPQVATPQDRRFLQAVSLMHSEFAQLPALYEMTVRNASTAVYACCNPIQETYFQQLAPAARSSGFPNPQDGAFSLSGKAKQKLLKHGVNLL

SEQ ID NO: 1428 - protein, 232 aa, Homo sapiens
MAPLCSLARWNYFFLYDGSKVKEEGDPTRAGICYFYPSQTLLDQQELLCGQIAGVVRCVSDISDSPPTLVRLRKLKFAIKVDGDYLWVLGCAVELPDVSCKRFLDQLVGFFNFYNGPVSLAYENCSQEELSTEWDTFIEQILKNTSDLHKIFNSLWNLDQTKVEPLLLLKAARILQTCQRSPHILAGCILYKGLIVSTQLPPSLTAKVLLHRTAPQEQRLPTGEDAPQEHGK

SEQ ID NO: 1429 - protein, 528 aa, Homo sapiens
MATSTSTEAKSASWWNYFFLYDGSKVKEEGDPTRAGICYFYPSQTLLDQQELLCGQIAGVVRCVSDISDSPPTLVRLRKLKFAIKVDGDYLWVLGCAVELPDVSCKRFLDQLVGFFNFYNGPVSLAYENCSQEELSTEWDTFIEQILKNTSDLHKIFNSLWNLDQTKVEPLLLLKAARILQTCQRSPHILAGCILYKGLIVSTQLPPSLTAKVLLHRTAPQEQRLPTGEDAPQEHGKWMLWSFKNRVTHQNPNGAALPPNVQIIPVFVTKEEAISLHEFPVEQMTRSLASPAGLQDGSAQHHPKGGSTSALKENATGHVESMAWTTPDPTSPDEACPDGRKENGCLSGHDLESIRPAGLHNSARGEVLGLSSSLGKELVFLQEELDLSEIHIPEAQEVEMASGHFAFLHVPVPDGRAPYCKASLSASSSLEPTPPEDTAISSLRPPSAPEMLTQHGAQEQLEDHPGHSSQAPIPRADPLPKSTVLFSGGCVKGSDTQLCVPGLVWYLEPQFYYVIVRHFFDSMRQTAG

SEQ ID NO: 1430 - protein, 708 aa, Homo sapiens; identical to SEQ ID NO: 1425

SEQ ID NO: 1431 - protein, 196 aa, Homo sapiens; identical to SEQ ID NO: 1426

SEQ ID NO: 1432 - protein, 703 aa, Homo sapiens; identical to SEQ ID NO: 1427

SEQ ID NO: 1433 - protein, 232 aa, Homo sapiens; identical to SEQ ID NO: 1428

SEQ ID NO: 1434 - protein, 528 aa, Homo sapiens; identical to SEQ ID NO: 1429

SEQ ID NO: 1435 - protein, 837 aa, Homo sapiens
MSLSHLYRDGEGRIDDDDDERENFEITDWDLQNEFNPNRQRHWQTKEEATYGVWAERDSDDERPSFGGKRARDYSAPVNFISAGLKKGAAEEAELEDSDDEEKPVKQDDFPKDFGPRKLKTGGNFKPSQKGFAGGTKSFMDFGSWERHTKGIGQKLLQKMGYVPGRGLGKNAQGIINPIEAKQRKGKGAVGAYGSERTTQSMQDFPVVDSEEEAEEEFQKELSQWRKDPSGSKKKPKYSYKTVEELKAKGRISKKLTAPQKELSQVKVIDMTGREQKVYYSYSQISHKHNVPDDGLPLQSQQLPQSGKEAKAPGFALPELEHNLQLLIDLTEQEIIQNDRQLQYERDMVVNLFHELEKMTEVLDHEERVISNLSKVLEMVEECERRMQPDCSNPLTLDECARIFETLQDKYYEEYRMSDRVDLAVAIVYPLMKEYFKEWDPLKDCTYGTEIISKWKSLLENDQLLSHGGQDLSADAFHRLIWEVWMPFVRNIVTQWQPRNCDPMVDFLDSWVHIIPVWILDNILDQLIFPKLQKEVENWNPLTDTVPIHSWIHPWLPLMQARLEPLYSPIRSKLSSALQKWHPSDSSAKLILQPWKDVFTPGSWEAFMVKNIVPKLGMCLGELVINPHQQHMDAFYWVIDWEGMISVSSLVGLLEKHFFPKWLQVLCSWLSNSPNYEEITKWYLGWKSMFSDQVLAHPSVKDKFNEALDIMNRAVSSNVGAYMQPGARENIAYLTHTERRKDFQYEAMQERREAENMAQRGIGVAASSVPMNFKDLIETKAEEHNIVFMPVIGKRHEGKQLYTFGRIVIYIDRGVVFVQGEKTWVPTSLQSLIDMAK

SEQ ID NO: 1436 - protein, 196 aa, Homo sapiens
MTLQCTKSAGPWKMVVWDEDGFQGRRHEFTAECPSVLELGFETVRSLKVLSGAWVGFEHAGFQGQQYILERGEYPSWDAWGGNTAYPAERLTSFRPAACANHRDSRLTIFEQENFLGKKGELSDDYPSLQAMGWEGNEVGSFHVHSGAWVCSQFPGYRGFQYVLECDHHSGDYKHFREWGSHAPTFQVQSIRRIQQ

SEQ ID NO: 1437 - protein, 1319 aa, Homo sapiens
MFGLDQFEPQVNSRNAGQGERNFNETGLSMNTHFKAPAFHTGGPPGPVDPAMSALGQPPILGMNMEPYGFHARGHSELHAGGLQAQPVHGFFGGQQPHHGHPGSHHPHQHHPHFGGNFGGPDPGASCLHGGRLLGYGGAAGGLGSQPPFAEGYEHMAESQGPESFGPQRPGNLPDFHSSGASSHRVPAPCLPLDQSPNRAASFHGLPSSSGSDSHSLEPRRVTNQGAVDSLEYNYRARRPRDILTCFRPLTPKGSCLIMQRVARFLGGGFPGAPSAMPRAAGMVGLSKMHAQPPQQQPQQQQQPQQQQQHGVFFERFSGARKMPVGLEPSVGSRHPLMQPPQQAPPPPQQQPPQQPPQQQPPPPPGLLVRQNSLPACAPSAPAGRGGHAQRRPAGRRPHAAQPARAIRVSHPPAGEPEHAPLFRACFQHAASSSAAGAQPAAAAFRRAPLHERGQEARFDFPGSAGVDRCASWNGSMHNGALDNHLSPSAYPGLPGEFTPPVPDSFPSGPPLQHPAPDHQSLQQQQQQQQQQQQQQQQQQQQQQQQQQQQRQNAALMIKQMASRNQQQRLRQPNLAQLGHPGDVGQGGLVHGGPVGGLAQPNFEREGGSTGAGRLGTFEQQAPHLAQESAWFSGPHPPPGDLLPRRMGGSGLPADCGPHDPSLAPPPPPGGSGVLFRGPLQEPMRMPGEATCRAAFTGLQFGGSLGGLGQLQSPGAGVGLPSAASERRPPPPDFATSALGGQPGFPFGAAGRQSTPHSGPGVNSPPSAGGGGGSSGGGGGGGAYPPQPDFQPSQRTSASKLGALSLGSFNKPSSKDNLFGQSCLAALSTACQNMIASLGAPNLNVTFNKKNPPEGKRKLSQNETDGAAVAGNPGSDYFPGGTAPGGPRTRRPSGTSSSGSKASGPPNPPAQGDGTSLSPNYTLESTSGNDGKPVSGGGGRGRGRRKRDSGHVSPGTFFDKYSAAPDSGGAPGVSPGQQQASGAAVGGSSAGETRGAPTPHEKALTSPSWGKGAELLLGDQPDLIGSLDGGAKSDSSSPNVGEFASDEVSTSYANEDEVSSSSDNPQALVKASRSPLVTGSPKLPPRGVGAGEHGPKAPPPALGLGIMSNSTSTPDSYGGGGGPGHPGTPGLEQVRTPTSSSGAPPPDEIHPLEILQAQIQLQRQQFSISEDQPLGLKGGKKGECAVGASGAQNGDSELGSCCSEAVKSAMSTIDLDSLMAEHSAAWYMPADKALVDSADDDKTLAPWEKAKPQNPNSKEAHDLPANKASASQPGSHLQCLSVHCTDDVGDAKARASVPTWRSLHSDISNRFGTFVAALT

SEQ ID NO: 1438 - protein, 543 aa, Homo sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 1439 - protein, 514 aa, Homo sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 1440 - protein, 757 aa, Homo sapiens
MPALPLDQLQITHKDPKTGKLRTSPALHPEQKADRYFVLYKPPPKDNIPALVEEYLERATFVANDLDWLLALPHDKFWCQVIFDETLQKCLDSYLRYVPRKFDEGVASAPEVVDMQKRLHRSVFLTFLRMSTHKESKDHFISPSAFGEILYNNFLFDIPKILDLCVLFGKGNSPLLQKMIGNIFTQQPSYYSDLDETLPTILQVFSNILQHCGLQGDGANTTPQKLEERGRLTPSDMPLLELKDIVLYLCDTCTTLWAFLDIFPLACQTFQKHDFCYRLASFYEAAIPEMESAIKKRRLEDSKLLGDLWQRLSHSRKKLMEIFHIILNQICLLPILESSCDNIQGFIEEFLQIFSSLLQEKRFLRDYDALFPVAEDISLLQQASSVLDETRTAYILQAVESAWEGVDRRKATDAKDPSVIEEPNGEPNGVTVTAEAVSQASSHPENSEEEECMGAAAAVGPAMCGVELDSLISQVKDLLPDLGEGFILACLEYYHYDPEQVINNILEERLAPTLSQLDRNLDREMKPDPTPLLTSRHNVFQNDEFDVFSRDSVDLSRVHKGKSTRKEENTRSLLNDKRAVAAQRQRYEQYSVVVEEVPLQPGESLPYHSVYYEDEYDDTYDGNQVGANDADSDDELISRRPFTIPQVLRTKVPREGQEEDDDDEEDDADEEAPKPDHFVQDPAVLREKAEARRMAFLAKKGYRHDSSTAVAGSPRGHGQSRETTQERRKKEANKATRANHNRRTMADRKRSKGMIPS

SEQ ID NO: 1441 - protein, 793 aa, Homo sapiens
MPAGPVQAVPPPPPVPTEPKQPTEEEASSKEDSAPSKPVVGIIYPPPEVRNIVDKTASFVARNGPEFEARIRQNEINNPKFNFLNPNDPYHAYYRHKVSEFKEGKAQEPSAAIPKVMQQQQQTTQQQLPQKVQAQVIQETIVPKEPPPEFEFIADPPSISAFDLDVVKLTAQFVARNGRQFLTQLMQKEQRNYQFDFLRPQHSLFNYFTKLVEQYTKILIPPKGLFSKLKKEAENPREVLDQVCYRVEWAKFQERERKKEEEEKEKERVAYAQIDWHDFVVVETVDFQPNEQGNFPPPTTPEELGARILIQERYEKFGESEEVEMEVESDEEDDKQEKAEEPPSQLDQDTQVQDMDEGSDDEEEGQKVPPPPETPMPPPLPPTPDQVIVRKDYDPKASKPLPPAPAPDEYLVSPITGEKIPASKMQEHMRIGLLDPRWLEQRDRSIREKQSDDEVYAPGLDIESSLKQLAERRTDIFGVEETAIGKKIGEEEIQKPEEKVTWDGHSGSMARTQQAAQANITLQEQIEAIHKAKGLVPEDDTKEKIGPSKPNEIPQQPPPPSSATNIPSSAPPITSVPRPPTMPPPVRTTVVSAVPVMPRPPMASVVRLPPGSVIAPMPPIIHAPRINVVPMPPSAPPIMAPRPPPMIVPTAFVPAPPVAPVPAPAPMPPVHPPPPMEDEPTSKKLKTEDSLMPEEEFLRRNKGPVSIKVQVPNMQDKTEWKLNGQVLVFTLPLTDQVSVIKVKIHEATGMPAGKQKLQYEGIFIKDSNSLAYYNMANGAVIHLALKERGGRKK

SEQ ID NO: 1442 - protein, 403 aa, Homo sapiens
MSGRVGDLSPRQKEALAKFRENVQDVLPALPNPDDYFLLRWLRARSFDLQKSEAMLRKHVEFRKQKDIDNIISWQPPEVIQQYLSGGMCGYDLDGCPVWYDIIGPLDAKGLLFSASKQDLLRTKMRECELLLQECAHQTTKLGRKVETITIIYDCEGLGLKHLWKPAVEAYGEFLCMFEENYPETLKRLFVVKAPKLFPVAYNLIKPFLSEDTRKKIMVLGANWKEVLLKHISPDQVPVEYGGTMTDPDGNPKCKSKINYGGDIPRKYYVRDQVKQQYEHSVQISRGSSHQVEYEILFPGCVLRWQFMSDGADVGFGIFLKTKMGERQRAGEMTEVLPNQRYNSHLVPEDGTLTCSDPGIYVLRFDNTYSFIHAKKVNFTVEVLLPDKASEEKMKQLGAGTPK

SEQ ID NO: 1443 - protein, 687 aa, Homo sapiens
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNRGFSSASYLKVHVKTHHGVPLPQVSRHQEPILNGGAAFHCARTYGNKEGQKCSHQDPIESSDSYGDLSDASDLKTPEKQSANGSFSCDMAVPKNKMESDGEKKYPCPECGSFFRSKSYLNKHIQKVHVRALGGPLGDLGPALGSPFSPQQNMSLLESFGFQIVQSAFASSLVDPEVDQQPMGPEGK

SEQ ID NO: 1444 - protein, 641 aa, Homo sapiens
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNREGQKCSHQDPIESSDSYGDLSDASDLKTPEKQSANGSFSCDMAVPKNKMESDGEKKYPCPECGSFFRSKSYLNKHIQKVHVRALGGPLGDLGPALGSPFSPQQNMSLLESFGFQIVQSAFASSLVDPEVDQQPMGPEGK

SEQ ID NO: 1445 - protein, 537 aa, Homo sapiens
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQVWVGSSSGLPPLEPLPSDLPSWDFAQPALWRSSHSVPDTAFSLSLKKSFPALENLGPAHSSNTLFCPAPPGYLRQGWTTPEGSRAFTQWPVG

SEQ ID NO: 1446 - protein, 537 aa, Homo sapiens
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNRGLQAPGAHPEWGSSVPLRQDLWQQRRPEMLTSGSD

SEQ ID NO: 1447 - protein, 1211 aa, Homo sapiens
MKNLLTEKCISSHNFHQKVIKQRMEKKVDSRYFKDGAVKKPYSAKTLSNKKSSASFGIRRELPSTSHLVQYRGTHTCTRQGRLRELRIRCVARKFLYLWIRMTFGRVFPSKARFYYEQRLLRKVFEEWKEEWWVFQHEWKLCVRADCHYRYYLYNLMFQTWKTYVRQQQEMRNKYIRAEVHDAKQKMRQAWKSWLIYVVVRRTKLQMQTTALEFRQRIILRVWWSTWRQRLGQVRVSRALHASALKHRALSLQVQAWSQWREQLLYVQKEKQKVVSAVKHHQHWQKRRFLKAWLEYLQVRRVKRQQNEMAERFHHVTVLQIYFCDWQQAWERRESLYAHHAQVEKLARKMALRRAFTHWKHYMLLCAEEAAQFEMAEEHHRHSQLLLHRFWNLWRSQIEQKKERELLPLLHAAWDHYRIALLCKCIELWLQYTQKRRYKQLLQARADGHFQQRALPAAFHTWNRLWRWRHQENVLSARATRFHRETLEKQVFSLWRQKMFQHRENRLAERMAILHAERQLLYRSWFMWHQQAAARHQEQEWQTVACAHHRHGRLKKAFCLWRESAQGLRTERTGRVRAAEFHMAQLLRWAWSQWRECLALRGAERQKLMRADLHHQHSVLHRALQAWVTYQGRVRSILREVAARESQHNRQLLRGALRRWKENTMARVDEAKKTFQASTHYRRTICSKVLVQWREAVSVQMYYRQQEDCAIWEAQKVLDRGCLRTWFQRWWDCSRRSAQQRLQLERAVQHHHRQLLLEGLARWKTHHLQCVRKRLLHRQSTQLLAQRLSRTCFRQWRQQLAARRQEQRATVRALWFWAFSLQAKVWATWLAFVLERRRKKARLQWALQAYQGQLLQEGATRLLRFAASMKASRQQLQAQQQVQAAHSLHRAVRRCATLWKQKVLGRGGKPQPLAAIAPSRKVTFEGPLLNRIAAGAGDGTLETKRPQASRPLGALGRLAAEEPHALELNTAHSARKQPRRPHFLLEPAQSQRPQKPQEHGLGMAQPAAPSLTRPFLAEAPTALVPHSPLPGALSSAPGPKQPPTASTGPELLLLPLSSFMPCGAAAPARVSAQRATPRDKPPVPSSLASVPDPHLLLPGDFSATRAGPGLSTAGSLDLEAELEEIQQQLLHYQTTKQNLWSCRRQASSLRRWLELNREEPGPEDQEVEQQVQKELEQVEMQIQLLAEELQAQRQPIGACVARIQALRQALC

SEQ ID NO: 1448 - protein, 1211 aa, Homo sapiens; identical to SEQ ID NO: 1447

SEQ ID NO: 1449 - protein, 375 aa, Homo sapiens
MMCQSEARQGPELRAAKWLHFPQLALRRRLGQLSCMSRPALKLRSWPLTVLYYLLPFGALRPLSRVGWRPVSRVALYKSVPTRLLSRAWGRLNQVELPHWLRRPVYSLYIWTFGVNMKEAAVEDLHHYRNLSEFFRRKLKPQARPVCGLHSVISPSDGRILNFGQVKNCEVEQVKGVTYSLESFLGPRMCTEDLPFPPAASCDSFKNQLVTREGNELYHCVIYLAPGDYHCFHSPTDWTVSHRRHFPGSLMSVNPGMARWIKELFCHNERVVLTGDWKHGFFSLTAVGATNVGSIRIYFDRDLHTNSPRHSKGSYNDFSFVTHTNREGVPMRKGEHLGEFNLGSTIVLIFEAPKDFNFQLKTGQKIRFGEALGSL

SEQ ID NO: 1450 - protein, 1211 aa, Homo sapiens; identical to SEQ ID NO: 1447

SEQ ID NO: 1451 - protein, 1572 aa, Homo sapiens
MRTTKVYKLVIHKKGFGGSDDELVVNPKVFPHIKLGDIVEIAHPNDEYSPLLLQVKSLKEDLQKETISVDQTVTQVFRLRPYQDVYVNVVDPKDVTLDLVELTFKDQYIGRGDMWRLKKSLVSTCAYITQKVEFAGIRAQAGELWVKNEKVMCGYISEDTRVVFRSTSAMVYIFIQMSCEMWDFDIYGDLYFEKAVNGFLADLFTKWKEKNCSHEVTVVLFSRTFYDAKSVDEFPEINRASIRQDHKGRFYEDFYKVVVQNERREEWTSLLVTIKKLFIQYPVLVRLEQAEGFPQGDNSTSAQGNYLEAINLSFNVFDKHYINRNFDRTGQMSVVITPGVGVFEVDRLLMILTKQRMIDNGIGVDLVCMGEQPLHAVPLFKLHNRSAPRDSRLGDDYNIPHWINHSFYTSKSQLFCNSFTPRIKLAGKKPASEKAKNGRDTSLGSPKESENALPIQVDYDAYDAQVFRLPGPSRAQCLTTCRSVRERESHSRKSASSCDVSSSPSLPSRTLPTEEVRSQASDDSSLGKSANILMIPHPHLHQYEVSSSLGYTSTRDVLENMMEPPQRDSSAPGRFHVGSAESMLHVRPGGYTPQRALINPFAPSRMPMKLTSNRRRWMHTFPVGPSGEAIQIHHQTRQNMAELQGSGQRDPTHSSAELLELAYHEAAGRHSNSRQPGDGMSFLNFSGTEELSVGLLSNSGAGMNPRTQNKDSLEDSVSTSPDPMPGFCCTVGVDWKSLTTPACLPLTTDYFPDRQGLQNDYTEGCYDLLPEADIDRRDEDGVQMTAQQVFEEFICQRLMQGYQIIVQPKTQKPNPAVPPPLSSSPLYSRGLVSRNRPEEEDQYWLSMGRTFHKVTLKDKMITVTRYLPKYPYESAQIHYTYSLCPSHSDSEFVSCWVEFSHERLEEYKWNYLDQYICSAGSEDFSLIESLKFWRTRFLLLPACVTATKRITEGEAHCDIYGDRPRADEDEWQLLDGFVRFVEGLNRIRRRHRSDRMMRKGTAMKGLQMTGPISTHSLESTAPPVGKKGTSALSALLEMEASQKCLGEQQAAVHGGKSSAQSAESSSVAMTPTYMDSPRKVSVDQTATPMLDGTSLGICTGQSMDRGNSQTFGNSQNIGEQGYSSTNSSDSSSQQLVASSLTSSSTLTEILEAMKHPSTGVQLLSEQKGLSPYCFISAEVVHWLVNHVEGIQTQAMAIDIMQKMLEEQLITHASGEAWRTFIYGFYFYKIVTDKEPDRVAMQQPATTWHTAGVDDFASFQRKWFEVAFVAEELVHSEIPAFLLPWLPSRPASYASRHSSFSRSFGGRSQAAALLAATVPEQRTVTLDVDVNNRTDRLEWCSCYYHGNFSLNAAFEIKLHWMAVTAAVLFEMVQGWHRKATSCGFLLVPVLEGPFALPSYLYGDPLRAQLFIPLNISCLLKEGSEHLFDSFEPETYWDRMHLFQEAIAHRFGFVQDKYSASAFNFPAENKPQYIHVTGTVFLQLPYSKRKFSGQQRRRRNSTSSTNQNMFCEERVGYNWAYNTMLTKTWRSSATGDEKFADRLLKDFTDFCINRDNRLVTFWTSCLEKMHASAP

SEQ ID NO: 1452 - protein, 246 aa, Homo sapiens
MGDREQLLQRARLAEQAERYDDMASAMKAVTELNEPLSNEDRNLLSVAYKNVVGARRSSWRVISSIEQKTMADGNEKKLEKVKAYREKIEKELETVCNDVLSLLDKFLIKNCNDFQYESKVFYLKMKGDYYRYLAEVASGEKKNSVVEASEAAYKEAFEISKEQMQPTHPIRLGLALNFSVFYYEIQNAPEQACLLAKQAFDDAIAELDTLNEDSYKDSTLIMQLLRDNLTLWTSDQQDEEAGEGN

SEQ ID NO: 1453 - protein, 211 aa, Homo sapiens
MTPWLGLIVLLGSWSLGDWGAEACTCSPSHPQDAFCNSDIVIRAKVVGKKLVKEGPFGTLVYTIKQMKMYRGFTKMPHVQYIHTEASESLCGLKLEVNKYQYLLTGRVYDGKMYTGLCNFVERWDQLTLSQRKGLNYRYHLGCNCKIKSCYYLPCFVTSKNECLWTDMLSNFGYPGYQSKHYACIRQKGGYCSWYRGWAPPDKSIINATDP

SEQ ID NO: 1454 - protein, 492 aa, Homo sapiens
MDFLLGNPFSSPVGQRIEKATDGSLQSEDWALNMEICDIINETEEGPKDALRAVKKRIVGNKNFHEVMLALTVLETCVKNCGHRFHVLVASQDFVESVLVRTILPKNNPPTIVHDKVLNLIQSWADAFRSSPDLTGVVTIYEDLRRKGLEFPMTDLDMLSPIHTPQRTVFNSETQSGQDSVGTDSSQQEDSGQHAAPLPAPPILSGDTPIAPTPEQIGKLRSELEMVSGNVRVMSEMLTELVPTQAEPADLELLQELNRTCRAMQQRVLELIPQIANEQLTEELLIVNDNLNNVFLRHERFERFRTGQTTKAPSEAEPAADLIDMGPDPAATGNLSSQLAGMNLGSSSVRAGLQSLEASGRLEDEFDMFALTRGSSLADQRKEVKYEAPQATDGLAGALDARQQSTGAIPVTQACLMEDIEQWLSTDVGNDAEEPKGVTSEEFDKFLEERAKAADRLPNLSSPSAEGPPGPPSGPAPRKKTQEKDDDMLFAL

SEQ ID NO: 1455 - protein, 343 aa, Homo sapiens
MDNQAERESEAGVGLQRDEDDAPLCEDVELQDGDLSPEEKIFLREFPRLKEDLKGNIDKLRALADDIDKTHKKFTKANMVATSTAVISGVMSLLGLALAPATGGGSLLLSTAGQGLATAAGVTSIVSGTLERSKNKEAQARAEDILPTYDQEDREDEEEKADYVTAAGKIIYNLRNTLKYAKKNVRAFWKLRANPRLANATKRLLTTGQVSSRSRVQVQKAFAGTTLAMTKNARVLGGVMSAFSLGYDLATLSKEWKHLKEGARTKFAEELRAKALELERKLTELTQLYKSLQQKVRSRARGVGKDLTGTCETEAYWKELREHVWMWLWLCVCLCVCVYVQFT

SEQ ID NO: 1456 - protein, 367 aa, Homo sapiens
MEKKKMVTQGNQEPTTTPDAMVQPFTTIPFPPPPQNGIPTEYGVPHTQDYAGQTGEHNLTLYGSTQAHGEQSSNSPSTQNGSLTQTEGGAQTDGQQSQTQSSENSESKSTPKRLHVSNIPFRFRDPDLRQMFGQFGKILDVEIIFNERGSKGFGFVTFENSADADRAREKLHGTVVEGRKIEVNNATARVMTNKKMVTPYANGWKLSPVVGAVYGPELYAASSFQADVSLGNDAAVPLSGRGGINTYIPLIIPGFPYPTAATTAAAFRGAHLRGRGRTVYGAVRAVPPTAIPAYPGVDMQPTDMHSLLLQPQPPLLQPLQPLTVTVMAGCTQPTPTMPLPLPLAMELALWRVYTEVATADLPPTEVT

SEQ ID NO: 1457 - protein, 331 aa, Homo sapiens
MDSEKKRFTEEATKYFRERVSPVHLQILLTNNEAWKRFVTAAELPRDEADALYEALKKLRTYAAIEDEYVQQKDEQFREWFLKEFPQVKRKIQESIEKLRALANGIEEVHRGCTISNVVSSSTGAASGIMSLAGLVLAPFTAGTSLALTAAGVGLGAASAVTGITTSIVEHSYTSSAEAEASRLTATSIDRLKVFKEVMRDITPNLLSLLNNYYEATQTIGSEIRAIRQARARARLPVTTWRISAGSGGQAERTIAGTTRAVSRGARILSATTSGIFLALDVVNLVYESKHLHEGAKSASAEELRRQAQELEENLMELTQIYQRLNPCHTH

SEQ ID NO: 1458 - protein, 331 aa, Homo sapiens; identical to SEQ ID NO: 1457

SEQ ID NO: 1459 - protein, 331 aa, Homo sapiens; identical to SEQ ID NO: 1457

SEQ ID NO: 1460 - protein, 402 aa, Homo sapiens
MGLGQGWGWEASCFACLIRSCCQVVTFTFPFGFQGISQSLENVSGYYADARLEVGSTQLRTAGSCSHSFKRSFLEKKRFTEEATKYFRERVSPVHLQILLTNNEAWKRFVTAAELPRDEADALYEALKKLRTYAAIEDEYVQQKDEQFREWFLKEFPQVKRKIQESIEKLRALANGIEEVHRGCTISNVVSSSTGAASGIMSLAGLVLAPFTAGTSLALTAAGVGLGAASAVTGITTSIVEHSYTSSAEAEASRLTATSIDRLKVFKEVMRDITPNLLSLLNNYYEATQTIGSEIRAIRQARARARLPVTTWRISAGSGGQAERTIAGTTRAVSRGARILSATTSGIFLALDVVNLVYESKHLHEGAKSASAEELRRQAQELEENLMELTQIYQRLNPCHTH

SEQ ID NO: 1461 - protein, 202 aa, Homo sapiens
MSLAGLVLAPFTAGTSLALTAAGVGLGAASAVTGITTSIVEHSYTSSAEAEASRLTATSIDRLKVFKEVMRDITPNLLSLLNNYYEATQTIGSEIRAIRQARARARLPVTTWRISAGSGGQAERTIAGTTRAVSRGARILSATTSGIFLALDVVNLVYESKHLHEGAKSASAEELRRQAQELEENLMELTQIYQRLNPCHTH

SEQ ID NO: 1462 - protein, 202 aa, Homo sapiens; identical to SEQ ID NO: 1461

SEQ ID NO: 1463 - protein, 337 aa, Homo sapiens
MNPESSIFIEDYLKYFQDQVSRENLLQLLTDDEAWNGFVAAAELPRDEADELRKALNKLASHMVMKDKNRHDKDQQHRQWFLKEFPRLKRELEDHIRKLRALAEEVEQVHRGTTIANVVSNSVGTTSGILTLLGLGLAPFTEGISFVLLDTGMGLGAAAAVAGITCSVVELVNKLRARAQARNLDQSGTNVAKVMKEFVGGNTPNVLTLVDNWYQVTQGIGRNIRAIRRARANPQLGAYAPPPHIIGRISAEGGEQVERVVEGPAQAMSRGTMIVGAATGGILLLLDVVSLAYESKHLLEGAKSESAEELKKRAQELEGKLNFLTKIHEMLQPGQDQ

SEQ ID NO: 1464 - protein, 337 aa, Homo sapiens; identical to SEQ ID NO: 1463

SEQ ID NO: 1465 - protein, 1960 aa, Homo sapiens
MAQQAADKYLYVDKNFINNPLAQADWAAKKLVWVPSDKSGFEPASLKEEVGEEAIVELVENGKKVKVNKDDIQKMNPPKFSKVEDMAELTCLNEASVLHNLKERYYSGLIYTYSGLFCVVINPYKNLPIYSEEIVEMYKGKKRHEMPPHIYAITDTAYRSMMQDREDQSILCTGESGAGKTENTKKVIQYLAYVASSHKSKKDQGELERQLLQANPILEAFGNAKTVKNDNSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 1466 - protein, 166 aa, Homo sapiens
MAQRLLLRRFLASVISRKPSQGQWPPLTSRALQTPQCSPGGLTVTPNPARTIYTTRISLTTFNIQDGPDFQDRVVNSETPVVVDFHAQWCGPCKILGPRLEKMVAKQHGKVVMAKVDIDDHTDLAIEYEVSAVPTVLAMKNGDVVDKFVGIKDEDQLEAFLKKLIG

SEQ ID NO: 1467 - protein, 166 aa, Homo sapiens; identical to SEQ ID NO: 1466

SEQ ID NO: 1468 - protein, 548 aa, Homo sapiens
MAKFMTPVIQDNPSGWGPCAVPEQFRDMPYQPFSKGDRLGKVADWTGATYQDKRYTNKYSSQFGGGSQYAYFHEEDESSFQLVDTARTQKTAYQRNRMRFAQRNLRRDKDRRNMLQFNLQILPKSAKQKERERIRLQKKFQKQFGVRQKWDQKSQKPRDSSVEVRSDWEVKEEMDFPQLMKMRYLEVSEPQDIECCGALEYYDKAFDRITTRSEKPLRSIKRIFHTVTTTDDPVIRKLAKTQGNVFATDAILATLMSCTRSVYSWDIVVQRVGSKLFFDKRDNSDFDLLTVSETANEPPQDEGNSFNSPRNLAMEATYINHNFSQQCLRMGKERYNFPNPNPFVEDDMDKNEIASVAYRYRRWKLGDDIDLIVRCEHDGVMTGANGEVSFINIKTLNEWDSRHCNGVDWRQKLDSQRGAVIATELKNNSYKLARWTCCALLAGSEYLKLGYVSRYHVKDSSRHVILGTQQFKPNEFASQINLSVENAWGILRCVIDICMKLEEGKYLILKDPNKQVIRVYSLPDGTFSSDEDEEEEEEEEEEEEEEET

SEQ ID NO: 1469 - protein, 297 aa, Homo sapiens
MVHQVLYRALVSTKWLAESIRTGKLGPGLRVLDASWYSPGTREARKEYLERHVPGASFFDIEECRDTASPYEMMLPSEAGFAEYVGRLGISNHTHVVVYDGEHLGSFYAPRVWWMFRVFGHRTVSVLNGGFRNWLKEGHPVTSEPSRPEPAVFKATLDRSLLKTYEQVLENLESKRFQLVDSRSQGRFLGTEPEPDAVGLDSGHIRGAVNMPFMDFLTEDGFEKGPEELRALFQTKKVDLSQPLIATCRKGVTACHVALAAYLCGKPDVAVYDGSWSEWFRRAPPESRVSQGKSEKA

SEQ ID NO: 1470 - protein, 297 aa, Homo sapiens
MASPQLCRALVSAQWVAEALRAPRAGQPLQLLDASWYLPKLGRDARREFEERHIPGAAFFDIDQCSDRTSPYDHMLPGAEHFAEYAGRLGVGAATHVVIYDASDQGLYSAPRVWWMFRAFGHHAVSLLDGGLRHWLRQNLPLSSGKSQPAPAEFRAQLDPAFIKTYEDIKENLESRRFQVVDSRATGRFRGTEPEPRDGIEPGHIPGTVNIPFTDFLSQEGLEKSPEEIRHLFQEKKVDLSKPLVATCGSGVTACHVALGAYLCGKPDVPIYDGSWVEWYMRARPEDVISEGRGKTH

SEQ ID NO: 1471 - protein, 290 aa, Homo sapiens
MRMEAGEAAPPAGAGGRAAGGWGKWVRLNVGGTVFLTTRQTLCREQKSFLSRLCQGEELQSDRDETGAYLIDRDPTYFGPILNFLRHGKLVLDKDMAEEGVLEEAEFYNIGPLIRIIKDRMEEKDYTVTQVPPKHVYRVLQCQEEELTQMVSTMSDGWRFEQLVNIGSSYNYGSEDQAEFLCVVSKELHSTPNGLSSESSRKTKSTEEQLEEQQQQEEEVEEVEVEQVQVEADAQEKGSRPHPLRPEAELAVRASPRPLARPQSCHPCCYKPEAPGCEAPDHLQGLGVPI

SEQ ID NO: 1472 - protein, 321 aa, Homo sapiens
MQCRLPRGLAGALLTLLCMGLLCLRYHLNLSPQRVQGTPELSQPNPGPPKLQLHDVFIAVKTTRAFHRLRLELLLDTWVSRTREQTFVFTDSPDKGLQERLGSHLVVTNCSAEHSHPALSCKMAAEFDTFLASGLRWFCHVDDDNYVNPRALLQLLRAFPLARDVYVGRPSLNRPIHASEPQPHNRTRLVQFWFATGGAGFCINRKLALKMAPWASGSRFMDTSALIRLPDDCTMGYIIECKLGGRLQPSPLFHSHLETLQLLRTAQLPEQVTLSYGVFEGKLNVIKLQGPFSPEEDPSRFRSLHCLLYPDTPWCPQLGAR

SEQ ID NO: 1473 - protein, 1032 aa, Homo sapiens
MPGRAEAGEAEEEAGAGSGSEAEEDALWERIEGVRHRLARALNPAKLTPYLRQCRVIDEQDEEEVLSTYRFPCRVNRTGRLMDILRCRGKRGYEAFLEALEFYYPEHFTLLTGQEPAQRCSMILDEEGPEGLTQFLMTEVRRLREARKSQLQREQQLQARGRVLEEERAGLEQRLRDQQQAQERCQRLREDWEAGSLELLRLKDENYMIAMRLAQLSEEKNSAVLRSRDLQLAVDQLKLKVSRLEEECALLRRARGPPPGAEEKEKEKEKEKEPDNVDLVSELRAENQQLTASLRELQEGLQQEASRPGAPGSERILLDILEHDWREAQDSRQELCQKLHAVQGELQWAEELRDQYLQEMEDLRLKHRTLQKDCDLYKHRMATVLAQLEEIEKERDQAIQSRDRIQLQYSQSLIEKDQYRKQVRGLEAERDELLTTLTSLEGTKALLEVQLQRAQGGTCLKACASSHSLCSNLSSTWSLSEFPSPLGGPEATGEAAVMGGPEPHNSEEATDSEKEINRLSILPFPPSAGSILRRQREEDPAPPKRSFSSMSDITGSVTLKPWSPGLSSSSSSDSVWPLGKPEGLLARGCGLDFLNRSLAIRVSGRSPPGGPEPQDKGPDGLSFYGDRWSGAVVRRVLSGPGSARMEPREQRVEAAGLEGACLEAEAQQRTLLWNQGSTLPSLMDSKACQSFHEALEAWAKGPGAEPFYIRANLTLPERADPHALCVKAQEILRLVDSAYKRRQEWFCTRVDPLTLRDLDRGTVPNYQRAQQLLEVQEKCLPSSRHRGPRSNLKKRALDQLRLVRPKPVGAPAGDSPDQLLLEPCAEPERSLRPYSLVRPLLVSALRPVVLLPECLAPRLIRNLLDLPSSRLDFQVCPAESLSGEELCPSSAPGAPKAQPATPGLGSRIRAIQESVGKKHCLLELGARGVRERVQNEIYPIVIHVEVTEKNVREVRGLLGRPGWRDSELLRQCRGSEQVLWGLPCSWVQVPAHEWGHAEELAKVVRGRILQEQARLVWVECGSSRGCPSSSEA

SEQ ID NO: 1474 - protein, 639 aa, Homo sapiens
MEPAMEPETLEARINRATNPLNKELDWASINGFCEQLNEDFEGPPLATRLLAHKIQSPQEWEAIQALTVLETCMKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALAEILQANDNLTQVINLYKQLVRGEEVNGDATAGSIPGSTSALLDLSGLDLPPAGTTYPAMPTRPGEQASPEQPSASVSLLDDELMSLGLSDPTPPSGPSLDGTGWNSFQSSDATEPPAPALAQAPSMESRPPAQTSLPASSGLDDLDLLGKTLLQQSLPPESQQVRWEKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 1475 - protein, 639 aa, Homo sapiens; identical to SEQ ID NO: 1474

SEQ ID NO: 1476 - protein, 621 aa, Homo sapiens
MAESFKELDPDSSMGKALEMSCAIQNQLARILAEFEMTLERDVLQPLSRLSEEELPAILKHKKSLQKLVSDWNTLKSRLSQATKNSGSSQGLGGSPGSHSHTTMANKVETLKEEEEELKRKVEQCRDEYLADLYHFVTKEDSYANYFIRLLEIQADYHRRSLSSLDTALAELRENHGQADHSPSMTATHFPRVYGVSLATHLQELGREIALPIEACVMMLLSEGMKEEGLFRLAAGASVLKRLKQTMASDPHSLEEFCSDPHAVAGALKSYLRELPEPLMTFDLYDDWMRAASLKEPGARLQALQEVCSRLPPENLSNLRYLMKFLARLAEEQEVNKMTPSNIAIVLGPNLLWPPEKEGDQAQLDAASVSSIQVVGVVEALIQSADTLFPGDINFNVSGLFSAVTLQDTVSDRLASEELPSTAVPTPATTPAPAPAPAPAPAPALASAATKERTESEVPPRPASPKVTRSPPETAAPVEDMARRTKRPAPARPTMPPPQVSGSRSSPPAPPLPPGSGSPGTPQALPRRLVGSSLRAPTVPPPLPPTPPQPARRQSRRSPASPSPASPGPASPSPVSLSNPAQVDLGAATAEGGAPEAISGVPTPPAIPPQPRPRSLASETN

SEQ ID NO: 1477 - protein, 419 aa, Homo sapiens
MWPGNAWRAALFWVPRGRRAQSALAQLRGILEGELEGIRGAGTWKSERVITSRQGPHIRVDGVSGGILNFCANNYLGLSSHPEVIQAGLQALEEFGAGLSSVRFICGTQSIHKNLEAKIARFHQREDAILYPSCYDANAGLFEALLTPEDAVLSDELNHASIIDGIRLCKAHKYRYRHLDMADLEAKLQEAQKHRLRLVATDGAFSMDGDIAPLQEICCLASRYGALVFMDECHATGFLGPTGRGTDELLGVMDQVTIINSTLGKALGGASGGYTTGPGPLVSLLRQRARPYLFSNSLPPAVVGCASKALDLLMGSNTIVQSMAAKTQRFRSKMEAAGFTISGASHPICPVMLGDARLASRMADDMLKRGIFVIGFSYPVVPKGKARIRVQISAVHSEEDIDRCVEAFVEVGRLHGALP

SEQ ID NO: 1478 - protein, 127 aa, Homo sapiens
MSDNEDNFDGDDFDDVEEDEGLDDLENAEEEGQENVEILPSGERPQANQKRITTPYMTKYERARVLGTRALQIAMCAPVMVELEGETDPLLIAMKELKARKIPIIIRRYLPDGSYEDWGVDELIITD

SEQ ID NO: 1479 - protein, 416 aa, Homo sapiens
MELRVGNKYRLGRKIGSGSFGDIYLGANIASGEEVAIKLECVKTKHPQLHIESKFYKMMQGGVGIPSIKWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFSTYLNFCRSLRFDDKPDYSYLRQLFRNLFHRQGFSYDYVFDWNMLKFGAARNPEDVDRERREHEREERMGQLRGSATRALPPGPPTGATANRLRSAAEPVASTPASRIQPAGNTSPRAISRVDRERKVSMRLHRGAPANVSSSDLTGRQEVSRIPASQTSVPFDHLGK

SEQ ID NO: 1480 - protein, 416 aa, Homo sapiens; identical to SEQ ID NO: 1479

SEQ ID NO: 1481 - protein, 214 aa, Homo sapiens
MNVFRILGDLSHLLAMILLLGKIWRSKCCKGISGKSQILFALVFTTRYLDLFTNFISIYNTVMKVVFLLCAYVTVYMIYGKFRKTFDSENDTFRLEFLLVPVIGLSFLENYSFTLLEILWTFSIYLESVAILPQLFMISKTGEAETITTHYLFFLGLYRALYLANWIRRYQTENFYDQIAVVSGVVQTIFYCDFFYLYVTKVLKGKKLSLPMPI

SEQ ID NO: 1482 - protein, 220 aa, Homo sapiens
MNVFRILGDLSHLLAMILLLGKIWRSKCCKGISGKSQILFALVFTTRYLDLFTNFISIYNTVMKVVFLLCAYVTVYMIYGKFRKTFDSENDTFRLEFLLVPVIGLSFLENYSFTLLEILWTFSIYLESVAILPQLFMISKTGEAETITTHYLFFLGLYRALYLANWIRRYQTENFYDQIAVVSGVVQTIFYCDFFYLYVTKGRSWDDSNADTGLRSYSSI

SEQ ID NO: 1483 - protein, 340 aa, Homo sapiens
MKEDQVVAEEPGFQDEEESLFQDIDLLQKHGINVADIKKLKSVGICTIKGIQMTTRRALCNVKGLSEAKVDKIKEAANKLIEPGFLTAFEYSEKRKMVFHITTGSQEFDKLLGGGIESMAITEAFGEFRTGKTQLSHTLCVTAQLPGAGGYPGGKIIFIDTENTFRPDRLRDIADRFNVDHDAVLDNVLYARAYTSEHQMELLDYVAAKFHEEAGIFKLLIIDSIMALFRVDFSGRGELAERQQKLAQMLSRLQKISEEYNVAVFVTNQMTADPGATMTFQADPKKPIGGHILAHASTTRISLRKGRGELRIAKIYDSPEMPENEATFAITAGGIGDAKE

SEQ ID NO: 1484 - protein, 126 aa, Homo sapiens
MPFFGNTFSPKKTPPRKSASLSNLHSLDRSTREVELGLEYGSPTMNLAGQSLKFENGQWIAETGVSGGVDRREVQRLRRRNQQLEEENNLLRLKVDILLDMLSESTAESHLMEKELDELRISRKRK

SEQ ID NO: 1485 - protein, 142 aa, Homo sapiens
MAAAVAAAGAGEPQSPDELLPKGDAEKPEEELEEDDDEELDETLSERLWGLTEMFPERVRSAAGATFDLSLFVAQKMYRFSRAALWIGTTSFMILVLPVVFETEKLQMEQQQQLQQRQILLGPNTGLSGGMPGALPSLPGKI

SEQ ID NO: 1486 - protein, 202 aa, Homo sapiens
MSCVPWKGDKAKSESLELPQAAPPQIYHEKQRRELCALHALNNVFQDSNAFTRDTLQEIFQRLSPNTMVTPHKKSMLGNGNYDVNVIMAALQTKGYEAVWWDKRRDVGVIALTNVMGFIMNLPSSLCWGPLKLPLKRQHWICVREVGGAYYNLDSKLKMPEWIGGESELRKFLKHHLRGKNCELLLVVPEEVEAHQSWRTDV

SEQ ID NO: 1487 - protein, 717 aa, Homo sapiens
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGEDLRVRRRRGTGGSESSRASGLVGRKATEDFLGSSSGYSSEDDYVGYSDVDQQSSSSRLRSAVSRAGSLLWMVATSPGRLFRLLYWWAGTTWYRLTTAASLLDVFVLTRRFSSLKTFLWFLLPLLLLTCLTYGAWYFYPYGLQTFHPALVSWWAAKDSRRPDEGWEARDSSPHFQAEQRVMSRVHSLERRLEALAAEFSSNWQKEAMRLERLELRQGAPGQGGGGGLSHEDTLALLEGLVSRREAALKEDFRRETAARIQEELSALRAEHQQDSEDLFKKIVRASQESEARIQQLKSEWQSMTQESFQESSVKELRRLEDQLAGLQQELAALALKQSSVAEEVGLLPQQIQAVRDDVESQFPAWISQFLARGGGGRVGLLQREEMQAQLRELESKILTHVAEMQGKSAREAAASLSLTLQKEGVIGVTEEQVHHIVKQALQRYSEDRIGLADYALESGGASVISTRCSETYETKTALLSLFGIPLWYHSQSPRVILQPDVHPGNCWAFQGPQGFAVVRLSARIRPTAVTLEHVPKALSPNSTISSAPKDFAIFGFDEDLQQEGTLLGKFTYDQDGEPIQTFHFQAPTMATYQVVELRILTNWGHPEYTCIYRFRVHGEPAH

SEQ ID NO: 1488 - protein, 584 aa, Homo sapiens
MDEGCGETIYVIGQGSDGTEYGLSEADMEASYATVKSMAEQIEADVILLRERQEAGGRVRDYLVRKRVGDNDFLEVRVAVVGNVDAGKSTLLGVLTHGELDNGRGFARQKLFRHKHEIESGRTSSVGNDILGFDSEGNVVNKPDSHGGSLEWTKICEKSTKVITFIDLAGHEKYLKTTVFGMTGHLPDFCMLMVGSNAGIVGMTKEHLGLALALNVPVFVVVTKIDMCPANILQETLKLLQRLLKSPGCRKIPVLVQSKDDVIVTASNFSSERMCPIFQISNVTGENLDLLKMFLNLLSPRTSYREEEPAEFQIDDTYSVPGVGTVVSGTTLRGLIKLNDTLLLGPDPLGNFLSIAVKSIHRKRMPVKEVRGGQTASFALKKIKRSSIRKGMVMVSPRLNPQASWEFEAEILVLHHPTTISPRYQAMVHCGSIRQTATILSMDKDCLRTGDKATVHFRFIKTPEYLHIDQRLVFREGRTKAVGTITKLLQTTNNSPMNSKPQQIKMQSTKKGPLTKRDEGGPSGGPAVGAPPPGDEASSVGAGQPAASSNLQPQPKPSSGGRRRGGQRHKVKSQGACVTPASGC

SEQ ID NO: 1489 - protein, 584 aa, Homo sapiens; identical to SEQ ID NO: 1488

SEQ ID NO: 1490 - protein, 241 aa, Homo sapiens
MNRCWALFLSLCCYLRLVSAEGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 1491 - protein, 226 aa, Homo sapiens
MFIMGLGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 1492 - protein, 504 aa, Homo sapiens
MAAQRRSLLQSEQQPSWTDDLPLCHLSGVGSASNRSYSADGKGTESHPPEDSWLKFRSENNCFLYGVFNGYDGNRVTNFVAQRLSAELLLGQLNAEHAEADVRRVLLQAFDVVERSFLESIDDALAEKASLQSQLPEGVPQHQLPPQYQKILERLKTLEREISGGAMAVVAVLLNNKLYVANVGTNRALLCKSTVDGLQVTQLNVDHTTENEDELFRLSQLGLDAGKIKQVGIICGQESTRRIGDYKVKYGYTDIDLLSAAKSKPIIAEPEIHGAQPLDGVTGFLVLMSEGLYKALEAAHGPGQANQEIAAMIDTEFAKQTSLDAVAQAVVDRVKRIHSDTFASGGERARFCPRHEDMTLLVRNFGYPLGEMSQPTPSPAPAAGGRVYPVSVPYSSAQSTSKTSVTLSLVMPSQGQMVNGAHSASTLDEATPTLTNQSPTLTLQSTNTHTQSSSSSSDGGLFRSRPAHSLPPGEDGRVEPYVDFAEFYRLWSVDHGEQSVVTAP

SEQ ID NO: 1493 - protein, 462 aa, Homo sapiens
MAAQRRSLLQSEQQPSWTDDLPLCHLSGVGSASNRSYSADGKGTESHPPEDSWLKFRSENNCFLYGVFNGYDGNRVTNFVAQRLSAELLLGQLNAEHAEADVRRVLLQAFDVVERSFLESIDDALAEKASLQSQLPEGVPQHQLPPQYQKILERLKTLEREISGGAMAVVAVLLNNKLYVANVGTNRALLCKSTVDGLQVTQLNVDHTTENEDELFRLSQLGLDAGKIKQVGIICGQESTRRIGDYKVKYGYTDIDLLSAAKSKPIIAEPEIHGAQPLDGVTGFLVLMSEGLYKALEAAHGPGQANQEIAAMIDTEFAKQTSLDAVAQAVVDRVKRIHSDTFASGGERARFCPRHEDMTLLVRNFGYPLGEMSQPTPSPAPAAGGRVYPVSVPYSSAQSTSKTSVTLSLVMPSQGQMVNGAHSASTLDEATPTLTKDPSRPASDLTAIPQCQLNLLGSLTPG

SEQ ID NO: 1494 - protein, 531 aa, Homo sapiens
MRRYKLFLMFCMAGLCLISFLHFFKTLSYVTFPRELASLSPNLVSSFFWNNAPVTPQASPEPGGPDLLRTPLYSHSPLLQPLPPSKAAEELHRVDLVLPEDTTEYFVRTKAGGVCFKPGTKMLERPPPGRPEEKPEGANGSSARRPPRYLLSARERTGGRGARRKWVECVCLPGWHGPSCGVPTVVQYSNLPTKERLVPREVPRRVINAINVNHEFDLLDVRFHELGDVVDAFVVCESNFTAYGEPRPLKFREMLTNGTFEYIRHKVLYVFLDHFPPGGRQDGWIADDYLRTFLTQDGVSRLRNLRPDDVFIIDDADEIPARDGVLFLKLYDGWTEPFAFHMRKSLYGFFWKQPGTLEVVSGCTVDMLQAVYGLDGIRLRRRQYYTMPNFRQYENRTGHILVQWSLGSPLHFAGWHCSWCFTPEGIYFKLVSAQNGDFPRWGDYEDKRDLNYIRGLIRTGGWFDGTQQEYPPADPSEHMYAPKYLLKNYDRFHYLLDNPYQEPRSTAAGGWRHRGPEGRPPARGKLDEAEV

SEQ ID NO: 1495 - protein, 463 aa, Homo sapiens
MAGAGERKGKKDDNGIGTAIDFVLSNARLVLGVGGAAMLGIATLAVKRMYDRAISAPTSPTRLSHSGKRSWEEPNWMGSPRLLNRDMKTGLSRSLQTLPTDSSTFDTDTFCPPRPKPVARKGQVDLKKSRLRMSLQEKLLTYYRNRAAIPAGEQARAKQAAVDICAELRSFLRAKLPDMPLRDMYLSGSLYDDLQVVTADHIQLIVPLVLEQNLWSCIPGEDTIMNVPGFFLVRRENPEYFPRGSSYWDRCVVGGYLSPKTVADTFEKVVAGSINWPAIGSLLDYVIRPAPPPEALTLEVQYERDKHLFIDFLPSVTLGDTVLVAKPHRLAQYDNLWRLSLRPAETARLRALDQADSGCRSLCLKILKAICKSTPALGHLTASQLTNVILHLAQEEADWSPDMLADRFLQALRGLISYLEAGVLPSALNPKVNLFAELTPEEIDELGYTLYCSLSEPEVLLQT

SEQ ID NO: 1496 - protein, 463 aa, Homo sapiens; identical to SEQ ID NO: 1495

SEQ ID NO: 1497 - protein, 351 aa, Homo sapiens
MTEMSFLSSEVLVGDLMSPFDQSGLGAEESLGLLDDYLEVAKHFKPHGFSSDKAKAGSSEWLAVDGLVSPSNNSKEDAFSGTDWMLEKMDLKEFDLDALLGIDDLETMPDDLLTTLDDTCDLFAPLVQETNKQPPQTVNPIGHLPESLTKPDQVAPFTFLQPLPLSPGVLSSTPDHSFSLELGSEVDITEGDRKPDYTAYVAMIPQCIKEEDTPSDNDSGICMSPESYLGSPQHSPSTRGSPNRSLPSPGVLCGSARPKPYDPPGEKMVAAKVKGEKLDKKLKKMEQNKTAATRYRQKKRAEQEALTGECKELEKKNEALKERADSLAKEIQYLKDLIEEVRKARGKKRVP

SEQ ID NO: 1498 - protein, 351 aa, Homo sapiens; identical to SEQ ID NO: 1497

SEQ ID NO: 1499 - protein, 531 aa, Homo sapiens; identical to SEQ ID NO: 1494

SEQ ID NO: 1500 - protein, 749 aa, Homo sapiens
MSGSHTPACGPFSALTPSIWPQEILAKYTQKEESAEQPEFYYDEFGFRVYKEEGDEPGSSLLANSPLMEDAPQRLRWQAHLEFTHNHDVGDLTWDKIAVSLPRSEKLRSLVLAGIPHGMRPQLWMRLSGALQKKRNSELSYREIVKNSSNDETIAAKQIEKDLLRTMPSNACFASMGSIGVPRLRRVLRALAWLYPEIGYCQGTGMVAACLLLFLEEEDAFWMMSAIIEDLLPASYFSTTLLGVQTDQRVLRHLIVQYLPRLDKLLQEHDIELSLITLHWFLTAFASVVDIKLLLRIWDLFFYEGSRVLFQLTLGMLHLKEEELIQSENSASIFNTLSDIPSQMEDAELLLGVAMRLAGSLTDVAVETQRRKHLAYLIADQGQLLGAGTLTNLSQVVRRRTQRRKSTITALLFGEDDLEALKAKNIKQTELVADLREAILRVARHFQCTDPKNCSVELTPDYSMESHQRDHENYVACSRSHRRRAKALLDFERHDDDELGFRKNDIITIVSQKDEHCWVGELNGLRGWFPAKFVEVLDERSKEYSIAGDDSVTEGVTDLVRGTLCPALKALFEHGLKKPSLLGGACHPWLFIEEAAGREVERDFASVYSRLVLCKTFRLDEDGKVLTPEELLYRAVQSVNVTHDAVHAQMDVKLRSLICVGLNEQVLHLWLEVLCSSLPTVEKWYQPWSFLRSPGWVQIKCELRVLCCFAFSLSQDWELPAKREAQQPLKEGVRDMLVKHHLFSWDVDG

SEQ ID NO: 1501 - DNA, 473 bp, Homo sapiens
ccgcctactactactaaattcgcggccgcgtcgactttttttttttttttttcttgagacggagccttaccctgttgcccaggctggagtgcaatggcgcgatctcggctcactgcaacctccgcctcccgggttcaagcaattctcctgcctcgaactcccaaatagttgcgattacaggtgggcgccaccatgcccagctgatttttttgtatctttagtagagacggggtttcaccacgttggccaggctggtctcaaactcctgaccttgtgatccgcatgccccggcctcccaaagtgctgagattacaggcatgagccaccgtgctcggccaaaaatgaagcgtttcttatttagtagaagaaagaagaccagctaaacaggaagcataatgaactcctagctaagctcagaggaatttgtctgcaaaacccttacagaacaccacacaatcaaattatttgctcgt

SEQ ID NO: 1502 - DNA, 2401 bp, Homo sapiens
ctgactctgtctgggcattcttcctgggctagagatgctctgcctcccagcagaagacaagagccctagaaagactgtcattcatttactggagagagaaatggttcatctacacacacactcagagcctggctagctacaaagccgtggtccgtggtaggatgtacgtcttagtggaataagtaaccttgagcagacaatggatccagcagtaacaagcctgccctgatgccggcgtaaattccgaaggagctggagaacgattcttcccttcactttatctaaatcctctgaaggatgagtgggaggatggtttcttctcccttcctgaaggttgttttgttggtgccttatgctaagagaactcagcagatacaaatttattattttcttttagacagcattttccctgcagttagaagaaaacagcagctcacattgaaaaatatctaattcccaaaatacgtgattccaatagggagtttatagaatttgcttcttaccaaagcaaaatcttgaatacatgaaatctaaaatcttgccaatttaatgaatgcctaataatttttaaatagcatatatcattttaatacattaaatagttggaagattgttgagggataatttgtcaattttttattaaaaagaaaattcataaaaattaaatattctacatttattttatattattatcttggcaattttattttttatgacaaaattctgagtctgttatattatccaaatcctaaaaagatttaattgattacagaaaaatgtattgggaaaaattgctttgcccctcttttttctctaagcaattcctgagttttaaaaatactccttaaaggaactaatttatttttcatggcccatcaccaatatccaagagagtaaccaatttttaaattctgaaccctgtcttgtgtgactttcaaactaaatgaaatgaagaggcctcaggcagtctgtgtttacacagggtggcaaaattaaccttaagttacttggatcactgcactggggacacttcagagcctctactcaggctacttttgagcatactatgtatgtcgctgtgcagaagcctacctctttcactctagataaaacaagactttctgagcacttactctgagcaaagcaccgtgccgcaagtacaaaggtggataagactcagtccttgatttgatggtctttgttggaataggttttcaaactgtaatgtcactgtgtctcccaggggccaaaagtttgctttcattgatgggtttcaaagtagggatgagtttacttataagtacacattgtgtcattagtatgcttgactctccatggtgcaaaatttctttctaatgctgatcaattgcaaacatgatagaacaatgaaatacttccaggacattctaaatcactctcctccttgtgagaaaatagggtagagagcctagcctggtacaggcagccatccatgtctgatgtgggtcatctctgagaatgacactcctcaaagggccagagggtgctctttcttcatttcccttacacatgggtgttattcaatacttatctacagccatgtgtcacttaacaactggaatatgttccaagaaatctgtcattaggctattttgttattgtgtgatcacagagtgtacttacacaaacctagggtggtatagttcactgtaccaccaaggccatatagtgtagcctaggctacaatatacctaggctatatagtatagcctgtagctcctaggctacaaacctggacagcatgttactgcactgagtactgtagcaattgttacacagtggtaactatttgtgtatctaaacatatctaaacatagaaaagatacagtaaaaatacagcagtataatcttatgggaccaccgttgtatatgtggtccatcgttgatggaaacattgttatgtggcacatgactgtatatgcttcgtatatagtgaacattcagcaaaggttttcatcaatgaatggataaattggcaacttttatgggcttaattgggctaaaatatatacggagtcactatttgacttaacacctagacattattttactgatatttttcaataattctgtttttgtaaagccttccttccatttgggtgcaatttccacttggggaaaatctcattccccatcctcttgtaattaaaaagcatggtttgtttgttttgtaactcaaagtaaattgagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1503 - protein, 71 aa, Homo sapiens
MFTIYEAYTVMCHITMFPSTMDHIYNGGPIRLYCCIFTVSFLCLDMFRYTNSYHCVTIATVLSAVTCCPGL

SEQ ID NO: 1504 - protein, 104 aa, Homo sapiens
MLVNGENFGVSLNIFPSVAINKSSGAPRRVPAQGSIKDHTAGLRLTALSPEHQSPAESGDNTSSLQRGTSPPAATSLRLLLSSKDSLGFKCHFPCFRDPGVLIA

SEQ ID NO: 1505 - DNA, 1977 bp, Homo sapiens
cttttgatgttaggcccagtggccttccccctgaccctagcagcctctcatgaagacccactgaaggaatgggacaagagtggaggtaggttggtacatcacagactcatggggcagcatctgcaagacccttttatgatttatgcagaggaagcctggcttggagttttttagaccacccgggtcaggatcttagttctgccacacactgtcttggacacgttatttcatatcttgtgagttatgattttttcatctataaatctggcccagtgtctcccttgcaggattgttgtgtgagtccaactggcaccaaggaggtgggaattctgcaagaacagctgtcagtggtcatcatacttgtgctgtctatgtgcatggctttattgatactcggtgttcataaattaatattcccatgtgaattaggcagttttttctgagtagcaaaaacctcaggatttcagaggcttgtttgacagcagatatgtatcttcatgctcaaggatctatgggttggttgtggtttggctgatctagttgcatggctggttcatgccggacttgtggttgattgggatctgctccacgtgtctttgatctgagttcagactaaaaggcagcaacagacagcggctatggagacatattccttttgtggtgcatcataagagggcaagaggaatagacttgggaacagcacactgtcacttctagccacattccattggctacagcaagtcagtgatccagtccagaatccagtgggacagggaagtaaacaccattcactctggtgggaagtactacaaagtcccatgacaaagggcagaaatgtgtagttcacagtcatgttggaagtgaactgggaagactcatgcagtctaccatactaactcagctgctccacttgggtgaagcaaggaaagcaaaagaataataaactgaggagcaggctgggagaggcattgactatgtatgcaagtaacagatacttatttttcataagcgtgtgcttagtaaagttgggttctggaggtcaatattataggaagatcatgatctttgattctgaaggatagcatatgtttatccttatgccagtaccacactgtcctgatttctttcaaagtcaggaaatagaagtccaacattgttcttcattttcaagattgttttggctatcctgagtccattgcatttccatatgcattttaagataagcttgtcagttccccatctaatttaaatttgtgattcagtgctcaggaagattcaattgctgttggcatctaagtttgaaggaaatggtttgatcgtttatccaacaaatatttattaatattgttgtgccgggcattgtagagttggtgctgcaacatacaccaataaacaaatccaaacacaatctttgtatccacatggcttacaattgaagaaaattagcagatattaatcagtcttcacgttgaaacataattaaaaactgagataaattccatgatctaatctgaagatgcagagtttctctgagaatataatatttaaggaagtacaggagttacctaggcactgaagatgagagaggaagccttccagacagagagaacaacatgggcaaaggacctgtggtggaacaactgcagcatgttccaggatctaagaaaatgtccaatgggccgggcacagaggctcacacctgtaatcccagcactttgggaggccaaggtgggcagatcacctgaggtcaggagttcgagaccagcctgctcgacatggcgaaaccctgtctctactaaaaatgcaaaaaagtagctgggcgtggtggcggacacctgtaatcccagctacttgggaggctgagggaggagaatcaattgaacccaggaggtggaggttgcaatgagccaagatcgcgccactgcactccagtctgggcaacgagtgaaactgtctcacaaaaaaaaaaaaaaaaaa

SEQ ID NO: 1506 - DNA, 531 bp, Homo sapiens
aagacacttttaatatccctgtttcccaggctgtagataaaggggttgagcatggaggtgaccaccgtgtacatcactgcagccactgcaccctttctgggggaagatgacacatctgaactgaggtaccctccaacacctcttccataaaatcagcaaacaactgacaggtgagacccacaggtggagaaggctttatacttcccacctgatgatgaaaccctcagaatggaggaaacaattttatagtaagagaaaagggtccccgagatgggaagaaaaccaaatatggcattagggaaatacatgattatgttattgatgaaggtgtcacaacggcaagatgggggagttgagacaggtcacataagaaattaggaatgtccacctccttgaagcaggtcattagtaatgcaatcaagttgtacagctgggagtctaatagactgagaaacaaaaagacagctatactaggatgccgcagaaacacatgttcatgattgctgaatgatatacagggtgacagatggc

SEQ ID NO: 1507 - DNA, 713 bp, Homo sapiens
tgtgggctcaagagccttactctttccatctcagtttaggggcgcagccagctcctcttcccaatagggctctttctgctttccctctccttggccctagatttgtaatccatgaaaaagcacaaggtcctggctccttgcggtcacattctggttctctgtgtttgtggactctgctctcactgttcacccagcactagcagtaccagatggttctgtggagtcctggggaatggagagagcacagtctgactccctgccaagtagccaggagttgacttgcccatggtccgctggctttcccaccacttcctacaggatgggatctaagagactcaagagctgggtttctttcagcactctgtactgtcccaaatagcaaacaaatcactttgtagccagatttctgaatggaaatgagaaattgaattctccatggacttttaggtttatgggggagttttagctgtgtttcttggttttatttcagccaaacatgtctgctttgattttttttttaaagtataagtggtctatatatatgttcaccttttaaatgtaaatgtttaaaaagtaagcatttatgtgtttccataactgacatctgatgcagacctcattctctccccctcttctacctcctcttttccccccttttcatactctgtgtatgggttctaataacatggttggttttcaaaaaaaaaaaaaag

SEQ ID NO: 1508 - DNA, 524 bp, Homo sapiens
aggattaagtagtaaatttattttttaatggtaacaaatatatgccattagtatgttcttaagttttgggtcacattggcaacagtgtctttattttttttttgaaattcttttcaggaatcctaaggttatagttcccttaaaaaaatatttgctgttttacctcttttaagactgtaaacaggacaaaaaggcatggatatgagaattagctagtgatcactggctattctaaatagtcactaaggcttgaattgtctcttcaccagatgcctgtcagaagtcccaaaggtttccctgatcatattaataactttataaaaaattgatcattattcattaaatattagatattagtaaggaaaatataaatgaagtctaaaccaaaactcttaaccagactaacttcaatgttatgaatcacaaaatctttttgattgattgctctattgacaagctcttatatgcttttagagaaagattaagtcccattataagagatgataaattttagtcacagacta

SEQ ID NO: 1509 - DNA, 325 bp, Homo sapiens
tctgagctgactcaggaccctgctgtgtctgtggccttgggacagacagtcaggatcacatgccaaggagacagtctcagaagttattatgcaagctggtaccagcagaagccaggacaggcccctgttcttgtcatctatggaaagactaggccctcaggggtcccagagcgattctctggctccagctcaggaaacacagcttccttgaccatcactggggctcaggcggaagatgaggctgactattactgttactcccgggacagtagtggtaaccacccccattgggtgttcggcggagggaccaagctgaccgtcctag

SEQ ID NO: 1510 - protein, 108 aa, Homo sapiens
SELTQDPAVSVALGQTVRITCQGDSLRSYYASWYQQKPGQAPVLVIYGKTRPSGVPERFSGSSSGNTASLTITGAQAEDEADYYCYSRDSSGNHPHWVFGGGTKLTVL

SEQ ID NO: 1511 - DNA, 382 bp, Homo sapiens
ggtcagcccaagactaccccgtcggtcattctgttcctgccgtcctgtgaggagccccaagccaacaaggccacactggtgtgtctcatgaataactttatccgggaatcttgatggtgacctggaaggcagatggtaccctcatcacccagagcgtggagaagaccacgccctccaaacagagcaacaacaagtacgtggccagcagctacctgagcctgacgcccgagcagtggaggtcccgcagaagctacagctgccaggttatgcaagaagggagcaccgtggagaagtcagtggcccctgcagaatgttcataggttccagcccccaccccaccacaggggcctggagctgcaggatcccaggggaggggtctctc

SEQ ID NO: 1512 - protein, 36 aa, Homo sapiens
GQPKTTPSVILFLPSCEEPQANKATLVCLMNNFIRE

SEQ ID NO: 1513 - DNA, 2239 bp, Homo sapiens
ggcacgagggttcttggagctgtgaggaggaacaaccatgtcatcagaatcgagcaaaaaacggaagcccaaagtgatccgaagcgatggagccccagctgaaggaaagcggaatcgatctgacaccgagcaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggcaatagaaatagaagaacggaggatccagagctgtgtgcatttcatgactctaaagaagcttaaccgattagcccacatcaggttgaagaaaggaagagatcagacccacgaggctaagcagaaagtagatgcctatcatctgcagctccagaacctgttgtatgaggtgatgcacctacagaaggagatcaccaaatgtttggagtttaagtcaaagcatgaagaaattgatctggtcagtttagaggagttttataaggaggctccaccagatatcagcaaggccgaagtcaccatgggagaccctcaccagcaaacactggcacgtctggactgggagctggagcagcggaaaaggctggcagagaagtaccgagagtgcctatctaacaaggagaagattctcaaggagattgaggtgaagaaggagtacctgagcagcctccagccccgcctcaacagcatcatgcaggcttcccttccggtgcaggagtacctgtttatgccattcgaccaggctcacaagcagtatgagacagccagacacctgccgcctcccctctatgtcctctttgttcaggccactgcgtatgggcaggcctgtgataagacgttatctgtggcaatcgaaggcagtgtggatgaagccaaggctctgttcaaacctccagaggactcccaagatgacgagagtgactcagatgccgaggaggagcagactacgaagcgccggagacccacactgggggttcagttggacgacaaacgcaaggagatgctgaagaggcacccactgtctgtcatgctcgacctgaagtgcaaagatgacagtgtgcttcacctgactttctactacctcatgaacctcaacatcatgacagtaaaagccaaagtgacaactgccatggagctgatcacccccatcagtgcaggtgacttgctgtctcctgactcagtcctgagttgcttgtatcctggggatcatggaaagaaaactccgaatccagccaatcagtatcagtttgataaagttggcatcctgactttgagcgactatgtacttgagctaggtcacccctatttgtgggtgcagaagctgggtggcctccacttccccaaagagcagccccagcaaacagtgattgctgaccactcgctgagcgccagccacatggagaccaccatgaaacttctgaagaccagggtgcagtcccgcctggccctccacaaacagtttgcatccctagaacatggcattgtgccagttaccagtgattgccagtacctcttccctgccaaggttgtctctcgcctggtgaaatgggtgacaattgcccatgaggattacatggagctgcacttcaccaaagacattgtggatgcgggactggctggggacaccaatctctactacatggcgctcatcgaaaggggcacagccaaactgcaggccgctgtggtgttgaaccctggctactcctccatcccacctattttccagctctgtttgaactggaaaggggagaaaaccaacagcaacgatgacaacattcgggccatggagggcgaagtcaatgtgtgctacaaggagctgtgtggcccttggcccagccaccagctgttgaccaaccagctgcagcggctgtgtgtgctgctggatgtttacctggagaccgagagccatgacgacagtgtggaggggcccaaggaatttccccaggagaagatgtgtctgcggctcttcaggggtcctagcaggatgaagccatttaaatacaaccatcctcagggattcttcagccatcgctgatctcccgcgcagaccgttgtttcccccaaggcctcaccctgagcactgggcttctgctttctgctctggcccacatgtgactcttgatattctccaaagacaccagccaattaaaaagcgtcacctgaaaaaaaaaaaaaaaaaaaaaaa

SEQ ID NO: 1514 - protein, 683 aa, Homo sapiens
MSSESSKKRKPKVIRSDGAPAEGKRNRSDTEQEGKYYSEEAEVDLRDPGRDYELYKYTCQELQRLMAEIQDLKSRGGKDVAIEIEERRIQSCVHFMTLKKLNRLAHIRLKKGRDQTHEAKQKVDAYHLQLQNLLYEVMHLQKEITKCLEFKSKHEEIDLVSLEEFYKEAPPDISKAEVTMGDPHQQTLARLDWELEQRKRLAEKYRECLSNKEKILKEIEVKKEYLSSLQPRLNSIMQASLPVQEYLFMPFDQAHKQYETARHLPPPLYVLFVQATAYGQACDKTLSVAIEGSVDEAKALFKPPEDSQDDESDSDAEEEQTTKRRRPTLGVQLDDKRKEMLKRHPLSVMLDLKCKDDSVLHLTFYYLMNLNIMTVKAKVTTAMELITPISAGDLLSPDSVLSCLYPGDHGKKTPNPANQYQFDKVGILTLSDYVLELGHPYLWVQKLGGLHFPKEQPQQTVIADHSLSASHMETTMKLLKTRVQSRLALHKQFASLEHGIVPVTSDCQYLFPAKVVSRLVKWVTIAHEDYMELHFTKDIVDAGLAGDTNLYYMALIERGTAKLQAAVVLNPGYSSIPPIFQLCLNWKGEKTNSNDDNIRAMEGEVNVCYKELCGPWPSHQLLTNQLQRLCVLLDVYLETESHDDSVEGPKEFPQEKMCLRLFRGPSRMKPFKYNHPQGFFSHR

SEQ ID NO: 1515 - DNA, 505 bp, Homo sapiens
tttatttattagaaaatgcaatttaatataaaatgtaatactgtattacaagatgcaatatattattcatactacacacacacacacgcctggacaataacttggaattgacaaatgcacatcctaaaatcctgtcacctcgctatgagttcatagttctctgataaccggcttcaagaggagaatggcttccccacttgcccccaagaagatagggatcactagtataagtcacatgatgaaagaaccagaataccagcctctcagactggaaggttcctgggcccttcccccttctttcctgacaagggcaggtgaggttcccccattagaaggatctggggcactgcttataagagcagcctgttacaagattcaagcacagagagctataggagttgaagtttggtttcttccacttaaaaaaatatatatccaccctccttactcaggggtagacctttcaaatattaataaataatgctgtgtgacattctgaataaac

SEQ ID NO: 1516 - DNA, 534 bp, Homo sapiens
ttttttttgcagcagggaaatacatgattatgttaatggtgaaggtgtcacaacatgcaagatgggagagttgagaagggtcacagaagaaattaggaatttccacatccttgaagcaggtcacttgtaaggcaatcaagttgtgcagctgggagtctaaaagactgagaaaaaaaaagacaacaaaactagaaaggcacagaaacacgggttcatgatggtgaatgatatagcgggtgacagatggctacaaaccagtcataggccatcacactcaggagcatgtctctcttccatgcctccaaaaatggcaaagagagacatctgagtcaggcagcctgcataggagatgactctgctgtgagactggatgtccacaatcatcttggggaccgtggtggaggtgaaaccgatgtcaggcaaggacaggttggagaggaagaagtacatgggggtgtggaggtgggagtcaaggcttgtggcctggatgatgagcaagtttcccagcacagtgaccaggcacttggacatgaa

SEQ ID NO: 1517 - DNA, 2504 bp, Homo sapiens
ctttatttacaaacacaggcagtagcttgccaaccccctaactagagcgtagctgtcactttgagacctgagtaacttctctgtaggattacacccttgcaagaattctgcccgcagcatttccgagtttgcattataaccttgtgggcagggcagtgaaagtactgttatataggaaagttaccgtctcctaggaattttgttttaagaaaaagattctaatactaaagtatgacatttgttgaatattttttattggcagtaggaaaggaaaattgaaattacatacaggaactccaaaagcttgctcgtgctcatttttcttctattacagattgaacatttaatgataaatgtgggtggggggatttaatatttcagaacagaaggcagagattaattttattttgccccctaaaatgtaatacattttctctctcttcttgccccctgccctgccctttcccactcctcctctctgtccctttgctgggatagggaaattgactgtaaggggattatgggtctatgtgggagggagagataagagggtctcagcaaaatgccaccttccaaccctgctatcgctgtaagcagtagggaaaggaaggggtaggtttatagctcccaacccatgatcaactagttctacttccttgattgtttgatcatggtcaatctgtagaggatccatttctgaagagctttgtttaaaacggccccttctctaaacaccttagagttttgcacccagtgccccggatcacccgctggaggccacagaggacaaacgctagttgcagtgtttgtgagctgcctttgctgaacagtagtgcgcgtgggaagcatcagcaattatccacctgtttctcaccatccctttccaaactgacttttactcattcatggccatggagatatatttgccagtctttgtcaattcatcagtttttttccaggaagtccttttcttttaaatgctatcatatgaaggctgcccttgctttaagcatttttgattgttcttattaaaatgaagaataaccccttccttctctcctaccccacactccctggaggtttaagtgagcagaaaatggtagtacgataaaagatccatgtaggtgggtttgcagaaaagttaatccaagataagtaacagattgaaaatgtaggcttctgactatgctagtgcaaaccgagttaaacggatcgattagagtttactttccaatatgattttgatgaatggtgtaacattgtgaaaggctttttgaagacaaaaccactaacccgttgtattgttttgttttgttttgttttgttttgttttaagagacagggtctcgctctgttgcccaggctggagggcaatggtatgatcatggctgactgcagcctggaactcctgggctcaagtgattctcccacctcagcctcctgagtagctgggattacaggcacacaccaccacacccagctaatttttgtattttttttgtagagatgaggtttcaccatgtttcccaggctgatctcgaactcctgggcccaagcgatcctcctgcctcggcctcccaaagtgctgggattacaggtgtgagccactgtattttaaaatacagtttttaaaataaaaaaactgtattttaaggattcaatttgaatttgtgtttagatccatgctaaggcatgcaagcaattgacacacggaccctgggatatgcggtgtcctgtctgactgattgattgatttctttctttttttttttttttttttgacagagtctcactaggtcaccaggctggagtgcagtggcacgatcttggctcactgcaacctccgcctcccaggttcaagcgattctcctgcctcagcctcctgagtagctgggattacaggcgcacgccaccacgcctagctaatttttgtatttttggtagaaatggggtttcaccatgtttgccaggatggtctcaatctcttgaccttgtgatctgcccgcctcagcctcccatagtgctaggattacaggcgtgagccagcgcacccagcctttttttgtgtgtgtgtttttagtagagatagggtttcaccatgttggccaggctgatctcaaactcctgacctcaggtgatccacccacctcagcctcccaaagtgctgggattacaggcatgagcctgatttacaggcactgatttctgacaatacatccttactatatatccaaaacttacctgccctttgaaacccagcctgtctcacctctacaaaaacaaacaaactaccttcctaaccattcctacgatactattctatttctgtgaattcttaaaatctgcttgaacagcccattttgacatttgattctctgtgtcagtgtttattgtcttagatttaccccctgcatgcagaagtgactgcatagtcactacttttagtgagtttgaaatctgtttggagagctatgtaagtaccaatggaaaaaaaaaaaaaaaaa

SEQ ID NO: 1518 - DNA, 1170 bp, Homo sapiens
ttggctcactgcaacctccgcctcccatgttcaggctgaggcaggagaatggcgtgaacccgggaggcggagtttgcagtgagccgagatcgtgccactgtactccagcctgggcgacagagcgagactccgtctcaaaaaaaaaaaaaagaaaataaagaaaagggatgaggagttcctggcatttttatttgtccccttttctccctctctagctctattaagacaaagcttttcagatttcacttaaacattaaccatagtttagaaattataattatcaccctatgacagaaggtaccctttcttggtacataattcaagctattaggaatttcttctgcattcactgggtttcatgaatgcaagtggtgtttgctaggtgcattctaaatttgacaaacatgagtgttgtcttggcctgcagacttaaaatagccacctgattataaaagaagtacaggtcttaagtgtatgtccaaatatggaacttgaatgatatggcaaaattagaaatgcaattttagaagtaattacactgttgtgtaaatggccacctcttttgaagtctttgctacattgcttataaaacactgagttgaacatgagaaagccttttgtccaaatatggaacttgaatgatatggcaaaattagaaatgcaattttagaagtaattacactgttgtgtaaatggccacctcttttgaagtctttgctacattgcttataaaacactgagttgaacatgagaaagccttttgtctgcagctgtacttttcaactggacatgaaccatgtacttttatggcacgtagatattcacatcaaatttctgatttgcagaccgattttatttttagttaacaaataagcttatcaaatgtggcttttgaactaaagcgcttttaattaaggagttataacagcatgttattttgagtagctgttactaaaatctgttgtgatggaacaatttggagtgagcatctgatatcagagataaagagagaagcatgcagtgagcatctggaagttcttgtaaaaaaaaaaacaaattaaacattctcatttgaatgcatttaaaatttttttaaattgccaattcctaagctttttctttgttagttgtagtttgctttctcgactgtataaaagaaaaaaaaaaaaa

SEQ ID NO: 1519 - DNA, 484 bp, Homo sapiens
  misc_feature 356, 359, 360, 361, 372, 373, 375, 376, 383, 396: n = A,T,C or G
tttggattttcagcaggaactttattccagtgctaatggcagacatcaggaaggaggagaggagccatttgtgcagatcatctagaagaacctggaccattcttgacagagctgaatacagtgatcacgttgtcctccaaggagcaggggtggggtggggtacttctaggagtcagttctgcaggctgtacaggaagcatggctggggaggcctcaggaaactgacaatcacggcagaaggcgaaggggaagcaggcacgtttcttcttaatattcctttgaaattctttatggtgcacaggtagcgtagaaaataactgcttcacactgactgtcatccctcctgggtggggggnggnnngaggttgtaanntnnccatagngataaacaccagncgggtcccaaccttcccgatacatgggagggagaaaatggggcattactcaatgcacaaagggggcttagaagctcccccccaaagcc

SEQ ID NO: 1520 - DNA, 1536 bp, Homo sapiens
cgagcacatgggccgcgggccgggcgggctcggggcggccgggacgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgctgtcagctgcatggagcttcgttcaagtattttctgagcctgatggatttacagtgatgttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagctgaccatactccctggagccttctcccgaggtgggcgggtgaccttggcacatacagccatcatgatggtactttaagtggaggctgaatcatctcccctttgagctgctttgggaacgtggcccccttggtgttccccttttactgccaggacactgagatttggagaggtaagtggcttacctgaggccatgtgctaacagagaagatgaagagatgattgaaacaggcctaagaccagacctaagggtctgtacattttccacatactttccatatctttagaggcctgaccaaagcagatcttttcctttcttctaggtaagtccaaaggcacctgcctgctgggcccactgttttctaactttcctaactttctgatcccttggaggtgataatcaaatattctagtctgaggcattgggatacatggtgctaggttctgagactctgcgtcaggcctgaaccctgcattttgtggaggtgggtgggagaatgttcccctggggaacatgcctagacacgggggacaacagttgccctcatggggaggtacctgtttactcgctgttatgggaccgctttcacaaaaccactgcaggtgagtgagttcctgctgaatatcaggcctggtgtctctagactcattattcccccacccaacccctatgttagttcatctcgagccacatttttattgccataatccaggcctggacaggccaagatcttttaacaattttaattactgaaaataataactgcatttttttttaaagcccaactttttggtaagtcagcccaaaatacagtctttgtgttgccatctgggaactggatttggaattgttcttccatgagactgcagagcagaacggcagggccagaggtcccacgagctggtcagacccggttctgctccttgctggctgagtgaccttgggcattgt

SEQ ID NO: 1521 - DNA, 5871 bp, Homo sapiens
gcaccacagaccagtctgtcctggtgttggatgttaaaagtggagccacaaagaagccatcttatgtgggacaggcttgggtgtgagaccagagctgtgggtagcagcatgttgggtcaggatgaggggcagaggaaacactttccacctcttggatatggattttatcctgccctgattcaggagatccccatctattaagtaaggggaaagatgattttgttgtcttttgtttcagattctaatgtaggaactggtgagaagaaggtgactgaagcctggatttctgaggatgaaaactcacataggacgacgtcagacagactcacggtgatggagctcccctctcccgagtctgaggaagtccacgagcccagattaggggagctcttgggaaatccagaaggtcagagcctggggagttccccctctcaggacaggggctgcaagcaggtgacagtgacccattggaagatccagacaggagagacagctcaagtgtgcaccaagtcaggaagaaaccatattctgaactcagaccttcttctgcttcagagagagctcatagagggggaagccaatccttgcgatatctgtggcaaaaccttcacgtttaattcggacctagttaggcatcggatttcgcatgctggggagaaaccttacacgtgcgatcagtgtgggaaaggctttggccagagctcacaccttatggagcatcagagaattcacactggagagagactctacgtctgtaatgtgtgtgggaaagacttcattcactattcaggtctcattgagcatcagcgcgttcattcaggagaaaagcccttcaaatgtgcgcagtgtgggaaggcgttttgtcacagttcagacctgattaggcaccagagagttcacaccagagagagaccttttgaatgcaaagagtgtgggaaaggcttcagtcagagctccttacttattcgccatcagaggattcacacgggagaaaggccctatgagtgcaatgaatgtgggaaatccttcataaggagctcgagcctcattcgccattatcagatccacacagaagtgaaacagtatgaatgcaaagaatgtgggaaggcattccgtcatcgctcagaccttattgaacaccagagaattcacaccggagagagaccctttgaatgcaatgagtgtgggaaagcctttattcggagttcaaagctcattcagcatcagaggatccatactggggagaggccttacgtatgcaatgagtgtgggaagcgcttcagccagacgtcaaacttcacccagcatcagagaattcacactggagagaaactctatgaatgtaacgagtgtgggaaagctttctttctgagttcataccttattcgacaccagaaaatccacactggagagagagtgtatgaatgtaaggaatgtgggaaagcgtttctccagaaagcccatctcactgagcaccagaagatccactctggggacaggcccttcgaatgtaaagactgtgggaaagccttcatccagagctccaagctgcttctgcaccagattattcacactggagaaaagccctatgtgtgcagttattgtgggaaaggctttattcagaggtcaaacttccttcaacaccagaaaattcatactgaagagaagctctatgaatgtagtcagtatgggagagattttaactcaactacaaacgttaaaaataatcaaagggttcaccaagagggactctccttgagtaaggcccccatacatttgggtgagaggtctgtagataagggggaacacacaggtaacttataaaataattactttcccgcccagtgagtgatgtttggaaatgcgtggaattaggattcatgtggtttctaagatttggacatgtcagaattttgtgagtcatggatggggctgcttttgcagtgggtgccacctgccactgtgcagccctactcggctcagcccttctcctcagctgtgagcactgtcctcaggagagtcacagggcttgacacctgactctgagctggaacagtaggggcagggagaagacaggtctcaagaaaaggtttttaagaagtttcatccccagttaagcagagtccatccttgacttaaatcccttattacagcacaactgtgtatctaatcttacgatttaggagaatgttacctaggacattttgatgtgttaagttgaagaaaggtaactcgtgtatgaaccccgagccatttccctgttgtcctgaggaggaactccaggcctcccatcgtgtgccctaaggcctcctgcgtcctggagccctgcctcccactgcctgacttcctgccacacggttaatgctgcagcaacaccgactgcttcatcttccctgtgctccacgtggcttcctacctctctcgcctttgttcttgttgaagggtctcttctcagctaattaactctgaatcatggttcaagacaagcctcaggcatcatgtcaatgggtgtttccctcaagcttagttggcagcactctccacacttctgtggctcagtgattactgctattactatatttacttgcatatgtcagaatgatgtgatagactatctctgtcactatgctgttgggttcctgaggacagtgatcatatctgattgatttccatgtgtccactgtctagcacagggcaataaaaaatacacccctaaatctatgtgtaattggcatctctcttgctttgtcctttctatactgccattctaaaaattttcagctgttggctgtttttttttgttgtttgttcattttgtatcagtataatctacgattctgttagaagtatcttctcagccctgctactgtctgctgctcctacttagaagttgcaggcaatatcctgtgcacatccacgccctcctgtgtgccaccttacagctcatgcagaactgtctacttgatctggagggcattgacacctggctcagctggaacagtggggacaggaggaggcaggtctcaagagaaggtctttacttacttgtctgtatctttctgtctcactcgaaaggcacagtctcaatgcgctacgtaactcttctgttgtagcagttctgaggttgaactgagctcttgtcattttccatgctctctggctcattgtgtcatttcaaaatgtattgatatctataaggaatagtcctcaatgttgggaaaacagatgagcaacccactaccctgaagtcatccaccgtgtagtggggaagacggagatcacagtagggtgagttaagtatgtgccctcaggtgtgaaggagcacaggtgagggggtgcctgctgtggcacagagctgggaaggccttacagaagaggtgacatttcagctgggccagagatcagtagagagcagctgaagaagaaaatagggtccaggagaggaatctgcagaaacatggagccatgacagatggctttttggctaggactgttcgaaagcaggcgaggtaaatggacagtggacagccgcctcgccaaactgttagtctttacctctgaatttcatctggacatgaaccccaaagtccagttttgtaacgatataatttttttctcatgaggccatattttgagttcttaaatactaccaaccctgaacgtctcaggacaaataattcaaaaaagagatctacattttctggaaaatcagcattactagagatgtttcaaatgtagattttaccagaccattttaatcaactttattgagattcaattttcatatagtaaaacgcctatttaagtgtacaaggttttgaaaaatctatacacctgtgtaaccaccaccacctgtgtaaccaccaccgccagaaccaaaaacgtttctgtcacccaaagaagttcccttttgccttttcctagttaagcccactccagccccagataaccactttctatcctcatagattagtgttgcttggtttagagcctcatacaaatggattcatttactatgtgttcttttgcgtctgatgtctcactttggcatgtttttagactcatccaagctgttttgtgtttcagtagttctccttgctgaatagtattccattgtgtggataagccatcatttgtttattcatccacgtgttaatgggtttccagtctcggctcttaaaactatgagcatttgtgtaaaagtatgtatttgcacatgtgtttttatttctcttgggtaagtacctaggactttaattgctgtgttgtaagtgtcttagttcattcaggctgccataacaaaataccatcaactgggaggcttataaacaacagaaatttatgttttacagttctggaggctgggaagtccaagatgagggtgtcaacatttggtgtctagtgagggcctgcttccttttaagtagatgtctttttactgtgactgcacgtggtggaaagggactagcaagcttaccccattcatgagggctctccccttgtgattctgtcccctccccaagaccccacctcatatcatcttatgggttaggaatttgacatgaattgtgcaaggatgtaaacattcagtccattgcaatgcgtgtttctaacttcctaagaaattgtcacacagccctctgtagtggttgaatcattttacactattactacattatgggaagattccagttgctccatatctttgctaacacttggcattgtcagtctcttaaaatttaatccactctagcctccttatgattttaatttgtatttgcccactgaataatgtatgtctatgatttcatctgcttattgcttttccgtgtcgtcttttgtgatgtgtctgttcgtgccttttgcctgtttttaagttgggatgcttattgttgactcaagttctttccatattctgcatgaaaaacatacatgtaatatatagaattctttgtctccatttgtgacaaatattgtgaatattttcatgtttggtttgcctgttcattttcttaatggtgtcttttgaatattttttattaagccaccactcctggccaactgtagttgaactcaggtattggaagggcttccgttttgttcttttcccattttttttttttgacttctagatcctttgcattttcgtataaaatttgaagtcaacttctatcaacttcaggccaggcccgtggctcatgcctgtataatcccagcactttgggaggccgaggcgggcggatcgcttgaggtcaggagttcaagaccagcctggccggggtggtgaaaccccatctctactaaaaatgcggaagagttagccaggcgtggtggcaggcgcctgtagaatcccagctgctcgggaggctgaggcaggagaattgcttgagcctgggaggtggaggtttcagtgagctgggatcgtggcattgcactctagcctgggcaaccaagagtgaaactgtctcaaaaaacaacttttatcaatgtctgcaaaaagaaagtcttctgggatttatagatcaatttagggagaaatgacattttaacaattctgagttttccaattgttgaacatggtgtactgccccatttatttagatctgttaatttctctcagtttgcagctctcacattttgttaaattcatgtatttaatatttctgcatgctattgcaagtggtaaggttttcaaaaagctgttttctagttattgctagtatatagaaatgcattagacttgtacattgatcttgtatcaagcaacttagatcagttaacttattctagtagcttttttctagattctttagcattttctatgtagataatcatgtcatctgtgaataaagtattttacttttccaattt

SEQ ID NO: 1522 - protein, 536 aa, Homo sapiens
MILLSFVSDSNVGTGEKKVTEAWISEDENSHRTTSDRLTVMELPSPESEEVHEPRLGELLGNPEGQSLGSSPSQDRGCKQVTVTHWKIQTGETAQVCTKSGRNHILNSDLLLLQRELIEGEANPCDICGKTFTFNSDLVRHRISHAGEKPYTCDQCGKGFGQSSHLMEHQRIHTGERLYVCNVCGKDFIHYSGLIEHQRVHSGEKPFKCAQCGKAFCHSSDLIRHQRVHTRERPFECKECGKGFSQSSLLIRHQRIHTGERPYECNECGKSFIRSSSLIRHYQIHTEVKQYECKECGKAFRHRSDLIEHQRIHTGERPFECNECGKAFIRSSKLIQHQRIHTGERPYVCNECGKRFSQTSNFTQHQRIHTGEKLYECNECGKAFFLSSYLIRHQKIHTGERVYECKECGKAFLQKAHLTEHQKIHSGDRPFECKDCGKAFIQSSKLLLHQIIHTGEKPYVCSYCGKGFIQRSNFLQHQKIHTEEKLYECSQYGRDFNSTTNVKNNQRVHQEGLSLSKAPIHLGERSVDKGEHTGNL

SEQ ID NO: 1523 - DNA, 672 bp, Homo sapiens
  misc_feature 433, 440, 536: n = A,T,C or G
gcggttccgagaacaagtgcactttattggttctgatacagaggagctgccagaaaagccagcaggcggctgcggcacccagccctgcccgaggggagcaccaggtctgcaggcaccgggcctgatccggagctgccaatcagcaggcagccctgcctgcacagtcctcttgggcagcccacagcctgtggccggcaagttccctccgtggaggcgtgggttcccaggtggccagtctttcctgcgcgaatggggcttctcacctggccacggccacagccacagtgccccagcctgcctagactccacgaggccccggtatctccaggacagctaaggctgctactcaccacgggctgtggctgccgcagagaccccaggccctcggcctctctggcctgctcgggcccacatcccgctgggcacagtccangcagcanggcaggactggctgcccacgaccaccctgcttgcgccacgcctggtgctctgagctggccgcctggtgcgggctgagagtagagggatggagcgtnctgcagtggccccagcatcaacaggtgcttctcgctgtcctctgggccagactctgggctggcttctgcttcccggctcgttcaaaagctgtggcagtggtccagagagccacgagatccagtgtgcctggcacgc

SEQ ID NO: 1524 - DNA, 2463 bp, Homo sapiens
gaagggggctgggccggagcccccaggctcagaggaggaggaggaggagcaggaggagagcctggcggtggcggagcagggaaaggggcgcagggagtctgaaagctccaggagcagcagaaggcccagtggccggtctccaaccagtactgagaagcgcatgagcttcgagtccatttcttccctgccagaggttgagccggaccctgaggctgggagtgagcaagaggtattttctgctgtggaagggcccagtgccgaggagacgccttcagacacagaatctccagaagtcctggagacacagcttgatgcccaccagggccttctggggatggaccccccaggtgacatggtggacttcgtggcagctgagagcactgaggaccttaaggccctgagcagcgaggaggaagaagaaatgggaggtgccgcccaggagcctgagagccttctgccaccctctgtgctggaccaggccagcgtcattgcggagcgatttgtcagcagcttctctcggcggagcagcgtggcacaggaggacagcaagtccagtggctttgggagcccgcggctggtcagccggagcagcagcgtgctcagcctggagggcagcgagaagggcctggcccggcatggcagtgccacagactccctcagctgtcagctctccccagaagtggacatcagtgtgggggtggccacagaggacagcccttctgtcaatgggatggagcccccaagcccaggctgcccagtggagcctgaccggtcttcctgcaagaagaaggaatcagcactctccacccgagaccggctgttgctagacaagattaagagctggtggccccactgcacccccgcatcgtgcagctctcccacgtaatggacagccacgtgagcgagcgcgtcaagaacaaggtctaccagctggcccgccagtacagcctccggatcaagagcaacaagccagtgatggccaggccaccactgcagtgggaaaaggtggcccctgagagggatgggaagagccccactgtgccctgtctacaggaagaggctggagagccattaggtggcaaaggtaagaggaagccggtgctgtctctatttgactatgagcagctgatggcccaggagcacagccctcccaagccctcctcggctggggagatgtcaccacagcgtttcttcttcaacccgtctgctgtcagccagaggaccacctcgcctgggggccggccctccgcccggagccccctcagccccacagagaccttcagctggcccgacgtccgtgagctctgctccaagtatgcctcccgcgatgaggcacgccgagcagggggcggccggccccgcggcccacccgtcaacaggagccactcggtgccggagaacatggtagagccacctctgtcgggcagggtgggccgctgccgcagcctgagcaccaagaggggccggggaggcggagaggctgcccaatcccctgggcctctgccccagagcaagccggatggaggcgagaccctgtatgtcactgcagacctcaccctggaggacaaccggcgggtgattgtcatggagaagggaccccttcccagccccactgcagggctggaggagagcagtggccagggaccaagctcaccggtggccctgctggggcaggttcaggacttccagcagtctgcagagtgccagccgaaggaagagggttccagggacccggcagacccgagccagcagggcagagtgagaaaccttagagagaagttccaggccttgaactctgtcggttgatgctgactcctgggggagggaggagtcatgttggaggttggggaagaacctgggcatccttcccctcaagcctgggctcatggagcccctgcccagggccctcaggtgggcggaaagtccatcccctccgcccttcaggaaggatgctcccgtgtgcaggggtctcctgcctgtgccatccactggggctcgagacaatttcccactcacctgtgaggccggtgtggctgcttcccttgtaaatagttgttctctggtaagaagccaaatatttaagctcacttcttcccagagagaggaagctctgctcaggcctccagcgttggctggccatggccacagccagatggaggagcccatccccaggagactcaggcagtggcctggagaggctttgttctgtaacggtgccttttcttagggtccaggcaggaatgaagccaataatttattgctttccattctgtggtatgatgtgcgtgtgcgtgagtgtgtggcccctgtttattcccctcctgtcaagaatgaagtggattcagttcaggtacttttgagggttgttgtgctgaccctgtggttgtcgctgatgtacacacatttcattatttgccaatggtgcaataaccactgctgaccaacaaaaaaaaaaaaaaaaaa

SEQ ID NO: 1525 - protein, 294 aa, Homo sapiens
KGAGPEPPGSEEEEEEQEESLAVAEQGKGRRESESSRSSRRPSGRSPTSTEKRMSFESISSLPEVEPDPEAGSEQEVFSAVEGPSAEETPSDTESPEVLETQLDAHQGLLGMDPPGDMVDFVAAESTEDLKALSSEEEEEMGGAAQEPESLLPPSVLDQASVIAERFVSSFSRRSSVAQEDSKSSGFGSPRLVSRSSSVLSLEGSEKGLARHGSATDSLSCQLSPEVDISVGVATEDSPSVNGMEPPSPGCPVEPDRSSCKKKESALSTRDRLLLDKIKSWWPHCTPASCSSPT

SEQ ID NO: 1526 - DNA, 899 bp, Homo sapiens
  misc_feature 9, 14, 648, 761, 835, 837, 839, 881, 883: n = A,T,C or G
tggaatccntcagncagttatttaatacaaggtcactcctcaatagcgttggctgtaccagtcgttgttgtttaactgaagaagttctgtcacaacctgcaggatattgtaattgtgtttcttcagcagccgtaggttcagctgcctgtcacagaatcccatttcaaagagatgggccatcagggctgctgtctgatcttcagaaattattggctgtgcagtgactggtggcccagcaaacagggccttgtatgcagaggcagcaacagacaaagcccccttcaccagtcctccagcaatgctgctcccatgatggtgccttgagtggtcatagctcttctgtctgctgtttacaagtcctgatgagcctctgggctctcctctgatctgatcagggactgaagaaacttctggtatggtaactggtaaatccactcctggggaaccatgatgatgtacacaaggagagctcctgggcagtgacggtggaagctccactacctctgggattaggggcactgtttccagagtctgtgaggtcgtgaggatgtcacttatgctgtgctcctgtggctggttctccccttcagggagtctttccccagcctcagctggttcctgcccagcctcaaccccaggcttgccttnagcacctcgctccaggcctggctgtgagagcgcagagctgtacataaaatcccccaaggggccggctggtattcaaaacactcaggcagggatgatgatgtaatccttttgangaaacagaaggactgacttttgaaccttcatcttttggacctcaatccttccttccttccttaattccttcctnantncttcttcccttccttcattgaaaaggctttttttccttcaancngatattgggaaaaatc

SEQ ID NO: 1527 - DNA, 561 bp, Homo sapiens
  misc_feature 391, 419, 439, 455, 472, 492: n = A,T,C or G
atttggattttccatatcctttaatgaattgcaaatatattaacagaaaagactttccccctcaacactgtacaatttctgaaataagtcagttaaagcaaaaagaagacacaaaattacattgtttcaatgcaaacagaacacacacttcatacccacacttgcattttcccaggttttcacaaagaaaatgggtcaccatatttctcagtgaagactcatactatactctggctaatcagagacttccaaacttttttcttcaaaaagagcatttttaatagactaaatactggttatcactgagtttttgtttaaggtacaacagcagcatggttcaaatgttacttgtagttctcggaaaaattaaaaattttaagtgatgaatacngaaaatgtaggggaccacctttcattcntttggggtacccctggttcncctggaaaaatattcnaaccttctaaaatcccngagttaagaaccatttccangggggaaaaccaatcccaggccaaacatacttctggacagtgtgtgcgcggatatatatatggatatag

SEQ ID NO: 1528 - DNA, 304 bp, Homo sapiens
agcggccgcgggcccgctcggcctcatggtagcgcgcgcgcaggtagaggtcctgcaggaaggcgtggtgggcggcggggaaggggcggctctcgagtagccggtagagctcggcgtactcgccccgctggaaggccaccagggcccgcgcgcgcaacaccgggtcgctgccacgtaggcgctcggccgggggcagtgcgcccaggaagcggctcaagcggccggcgtggcccgcctggagcagcgcctcgcagacgcacgccacctgctcgggcgagaagcggaggcccgtgggcggttcgga

What is claimed is:

1. A method of assessing a subject at risk for developing pancreatic adenocarcinoma, the method comprising:
    a) obtaining a pancreatic tissue or pancreatic juice sample from a subject suspected of being at risk for developing pancreatic adenocarcinoma cancer;
    b) determining a copy number of minimal common region (MCR) 50.06-62.89 Mb of human chromosome 19 in the subject pancreatic tissue or pancreatic juice sample using fluorescent in situ hybridization (FISH), quantitative PCR (qPCR), or comparative genomic hybridization (CGH);
    c) comparing the copy number of the MCR in the subject sample to the normal diploid copy number of the MCR, wherein an increased copy number of the MCR in the subject sample indicates that the subject is at risk for developing pancreatic adenocarcinoma cancer; and
    d) recommending pancreatic adenocarcinoma treatment to the subject at risk for developing pancreatic adenocarcinoma.

2. The method of claim 1, wherein the normal copy number is obtained from a control sample.

3. The method of claim 2, wherein said CGH is performed on an array.

* * * * *